(12) United States Patent
Sternlicht

(10) Patent No.: US 8,637,454 B2
(45) Date of Patent: Jan. 28, 2014

(54) TREATMENT OF MUCOSITIS WITH KALLIKREIN INHIBITORS

(75) Inventor: Andrew Sternlicht, Chestnut Hill, MA (US)

(73) Assignee: Dyax Corp., Cambridge, MA (US)

( * ) Notice: Subject to any disclaimer, the term of this patent is extended or adjusted under 35 U.S.C. 154(b) by 454 days.

(21) Appl. No.: 12/683,094

(22) Filed: Jan. 6, 2010

(65) Prior Publication Data

US 2010/0183625 A1 Jul. 22, 2010

Related U.S. Application Data

(60) Provisional application No. 61/142,746, filed on Jan. 6, 2009.

(51) Int. Cl.
*A61K 38/00* (2006.01)

(52) U.S. Cl.
USPC .......................................................... 514/2

(58) Field of Classification Search
None
See application file for complete search history.

(56) References Cited

U.S. PATENT DOCUMENTS

| | | |
|---|---|---|
| 3,682,776 A | 8/1972 | Grundmann et al. |
| 3,691,016 A | 9/1972 | Patel |
| 3,969,287 A | 7/1976 | Jaworek et al. |
| 4,118,481 A | 10/1978 | Schnabel et al. |
| 4,153,687 A | 5/1979 | Schnabel et al. |
| 4,179,337 A | 12/1979 | Davis et al. |
| 4,195,128 A | 3/1980 | Hildebrand et al. |
| 4,229,537 A | 10/1980 | Hodgins et al. |
| 4,247,642 A | 1/1981 | Hirohara et al. |
| 4,330,440 A | 5/1982 | Ayers et al. |
| 4,377,572 A | 3/1983 | Schwarz et al. |
| 4,595,674 A | 6/1986 | Tschesche et al. |
| 4,609,725 A | 9/1986 | Brady et al. |
| 4,657,893 A | 4/1987 | Krantz et al. |
| 4,845,242 A | 7/1989 | Powers et al. |
| 4,966,852 A | 10/1990 | Wun et al. |
| 5,106,833 A | 4/1992 | Broze, Jr. et al. |
| 5,166,133 A | 11/1992 | Houston et al. |
| 5,212,091 A | 5/1993 | Diaz-Collier et al. |
| 5,223,409 A | 6/1993 | Ladner et al. |
| 5,278,144 A | 1/1994 | Wolf |
| 5,278,285 A | 1/1994 | Ebbers et al. |
| 5,312,736 A | 5/1994 | Rasmussen et al. |
| 5,372,933 A | 12/1994 | Zamarron et al. |
| 5,373,090 A | 12/1994 | Norris et al. |
| 5,378,614 A | 1/1995 | Petersen et al. |
| 5,407,915 A | 4/1995 | Fritz et al. |
| 5,409,895 A | 4/1995 | Morishita et al. |
| 5,426,224 A | 6/1995 | Lee et al. |
| 5,441,931 A | 8/1995 | Sprecher et al. |
| 5,444,156 A | 8/1995 | Veloso et al. |
| 5,446,090 A | 8/1995 | Harris |
| 5,455,338 A | 10/1995 | Sprecher et al. |
| 5,466,783 A | 11/1995 | Wun et al. |
| 5,563,123 A | 10/1996 | Innis et al. |
| 5,576,294 A | 11/1996 | Norris et al. |
| 5,583,107 A | 12/1996 | Wolf et al. |
| 5,589,359 A | 12/1996 | Innis et al. |
| 5,618,696 A | 4/1997 | Norris et al. |
| 5,629,176 A | 5/1997 | Bjorn et al. |
| 5,635,187 A | 6/1997 | Bathurst et al. |
| 5,648,331 A | 7/1997 | Koudsi et al. |
| 5,663,143 A | 9/1997 | Ley et al. |
| 5,672,662 A | 9/1997 | Harris et al. |
| 5,677,146 A | 10/1997 | Sprecher et al. |
| 5,695,760 A | 12/1997 | Faanes et al. |
| 5,696,088 A | 12/1997 | Innis et al. |
| 5,719,041 A | 2/1998 | Lazarus et al. |
| 5,736,364 A | 4/1998 | Kelley et al. |
| 5,739,208 A | 4/1998 | Harris |
| 5,747,449 A | 5/1998 | Lasters et al. |
| 5,770,568 A | 6/1998 | Auerswald et al. |
| 5,780,265 A | 7/1998 | Dennis et al. |
| 5,786,328 A | 7/1998 | Dennis et al. |
| 5,795,865 A | 8/1998 | Markland et al. |
| 5,795,954 A | 8/1998 | Lazarus et al. |
| 5,800,385 A | 9/1998 | Demopulos et al. |
| 5,804,376 A | 9/1998 | Braxton et al. |
| 5,834,244 A | 11/1998 | Dennis et al. |
| 5,843,895 A | 12/1998 | Lazarus et al. |
| 5,853,723 A | 12/1998 | Jacobs et al. |
| 5,863,893 A | 1/1999 | Dennis et al. |
| 5,869,637 A | 2/1999 | Au-Young et al. |
| 5,874,407 A | 2/1999 | Kelley et al. |
| 5,880,256 A | 3/1999 | Dennis et al. |
| 5,900,461 A | 5/1999 | Harris |
| 5,914,316 A | 6/1999 | Brown et al. |

(Continued)

FOREIGN PATENT DOCUMENTS

| | | |
|---|---|---|
| AT | 275583 T | 9/2004 |
| CA | 2180950 A1 | 8/1995 |

(Continued)

OTHER PUBLICATIONS

Attwood (Science 290: 471-473, 2000).*
Skolnick et al. (Trends in Biotech. 18: 34-39, 2000).*
Fields & Noble, "Solid Phase Synthesis Utilizing 9-fluorenylmethocarbonyl Amino Acides," Int. J. Peptide Protein Research, 35:161-214 (1990).
Fraedrich, et al., "Reduction of Blood Transfusion requirement in Open Heart Surgery by Administration of High Doses of Aprotinin-Preliminary Results," Thorac Cardiovasc Surgeon, 37:89-91 (1989).
Freidinger, et al., "Protected Lactam-Bridged Dipeotides for Use as Conformational Constraints in Peptides," Journal of Organic Chemistry, 47:104-109 (1982).
Gardell, et al., "The Search for the Ideal Thrombolytic Agent: Maximize the Benefit and Minimize the Risk," Toxicologic Pathology, 21(2):190-198 (1993).

(Continued)

*Primary Examiner* — Sharon Wen
(74) *Attorney, Agent, or Firm* — Foley & Lardner LLP; Michel Morency; Shelby J. Walker

(57) ABSTRACT

Methods, kits and compositions are disclosed that include an isolated kallikrein inhibitor for the treatment of mucositis.

8 Claims, 13 Drawing Sheets

(56) References Cited

U.S. PATENT DOCUMENTS

| | | |
|---|---|---|
| 5,932,462 A | 8/1999 | Harris et al. |
| 5,962,266 A | 10/1999 | White et al. |
| 5,990,237 A | 11/1999 | Bentley et al. |
| 5,994,125 A | 11/1999 | Markland et al. |
| 6,001,596 A | 12/1999 | Hillman et al. |
| 6,004,579 A | 12/1999 | Bathurst et al. |
| 6,008,196 A | 12/1999 | Curran et al. |
| 6,010,880 A | 1/2000 | Markland et al. |
| 6,013,448 A | 1/2000 | Braxton et al. |
| 6,013,763 A | 1/2000 | Braisted et al. |
| 6,017,723 A | 1/2000 | Rao et al. |
| 6,057,287 A | 5/2000 | Markland et al. |
| 6,063,764 A | 5/2000 | Creasey et al. |
| 6,071,723 A | 6/2000 | Markland et al. |
| 6,087,473 A | 7/2000 | Conklin et al. |
| 6,090,916 A | 7/2000 | Vlasuk et al. |
| 6,103,499 A | 8/2000 | Markland et al. |
| 6,103,500 A | 8/2000 | Innis et al. |
| 6,113,896 A | 9/2000 | Lazarus et al. |
| 6,126,933 A * | 10/2000 | Warne et al. ............... 424/85.2 |
| 6,159,938 A | 12/2000 | Gyorkos et al. |
| 6,171,587 B1 | 1/2001 | Wun et al. |
| 6,174,721 B1 | 1/2001 | Innis et al. |
| 6,180,607 B1 | 1/2001 | Davies et al. |
| 6,214,966 B1 | 4/2001 | Harris |
| 6,242,414 B1 | 6/2001 | Johnson et al. |
| 6,258,351 B1 | 7/2001 | Harris |
| 6,261,279 B1 | 7/2001 | Demopulos et al. |
| 6,306,884 B1 | 10/2001 | Buckman et al. |
| 6,333,402 B1 | 12/2001 | Markland et al. |
| 6,348,558 B1 | 2/2002 | Harris et al. |
| 6,362,254 B2 | 3/2002 | Harris et al. |
| 6,362,276 B1 | 3/2002 | Harris et al. |
| 6,376,604 B2 | 4/2002 | Kozlowski |
| 6,407,213 B1 | 6/2002 | Carter et al. |
| 6,413,507 B1 | 7/2002 | Bentley et al. |
| 6,423,498 B1 | 7/2002 | Markland et al. |
| 6,432,397 B1 | 8/2002 | Harris |
| 6,455,639 B1 | 9/2002 | Yasukohchi et al. |
| 6,472,195 B2 | 10/2002 | Hillman et al. |
| 6,515,100 B2 | 2/2003 | Harris |
| 6,534,276 B1 | 3/2003 | Wun et al. |
| 6,548,262 B2 | 4/2003 | Gentz et al. |
| 6,576,235 B1 | 6/2003 | Williams et al. |
| 6,583,108 B1 | 6/2003 | Tamburini et al. |
| 6,610,281 B2 | 8/2003 | Harris |
| 6,624,246 B2 | 9/2003 | Kozlowski |
| 6,664,331 B2 | 12/2003 | Harris et al. |
| 6,689,582 B1 | 2/2004 | Davies et al. |
| 6,710,125 B2 | 3/2004 | Kozlowski |
| 6,774,180 B2 | 8/2004 | Kozlowski et al. |
| 6,783,960 B2 | 8/2004 | Innis et al. |
| 6,783,965 B1 | 8/2004 | Sherman et al. |
| 6,806,360 B2 | 10/2004 | Wun et al. |
| 6,814,982 B2 | 11/2004 | Poncin et al. |
| 6,914,135 B2 | 7/2005 | Sheppard et al. |
| 6,989,369 B2 | 1/2006 | Ladner et al. |
| 7,064,107 B2 | 6/2006 | Ladner et al. |
| 7,067,144 B2 | 6/2006 | Demopulos et al. |
| 7,153,829 B2 | 12/2006 | Ladner et al. |
| 7,166,576 B2 | 1/2007 | Cicardi et al. |
| 7,235,530 B2 | 6/2007 | Blair et al. |
| 7,276,480 B1 | 10/2007 | Ladner et al. |
| 7,704,949 B2 | 4/2010 | Ladner et al. |
| 7,718,617 B2 | 5/2010 | Cicardi et al. |
| 7,811,991 B2 | 10/2010 | Ladner et al. |
| 7,851,442 B2 | 12/2010 | Ladner et al. |
| 8,034,775 B2 | 10/2011 | Ladner et al. |
| 8,124,586 B2 | 2/2012 | Ladner et al. |
| 8,188,045 B2 | 5/2012 | Blair et al. |
| 8,283,321 B2 | 10/2012 | Markland et al. |
| 2001/0027180 A1 | 10/2001 | Isaacs |
| 2002/0102703 A1 | 8/2002 | Sheppard et al. |
| 2002/0111460 A1 | 8/2002 | Holloway |
| 2003/0012969 A1 | 1/2003 | Clark |
| 2003/0096733 A1 | 5/2003 | Ny et al. |
| 2003/0100070 A1 | 5/2003 | Holloway |
| 2003/0113726 A1 | 6/2003 | Tsuchihashi et al. |
| 2003/0114372 A1 | 6/2003 | White et al. |
| 2003/0153046 A1 | 8/2003 | Jensen et al. |
| 2003/0175919 A1 | 9/2003 | Ley et al. |
| 2003/0223977 A1 | 12/2003 | Ley et al. |
| 2004/0038893 A1 | 2/2004 | Ladner et al. |
| 2004/0049018 A1 | 3/2004 | Bailon et al. |
| 2004/0053206 A1 | 3/2004 | Cicardi et al. |
| 2004/0062746 A1 | 4/2004 | Martinez et al. |
| 2004/0062748 A1 | 4/2004 | Martinez et al. |
| 2004/0106747 A1 | 6/2004 | Bailon et al. |
| 2004/0126361 A1 | 7/2004 | Saifer et al. |
| 2004/0152633 A1 | 8/2004 | Jorgensen et al. |
| 2004/0171794 A1 | 9/2004 | Ladner et al. |
| 2004/0180827 A1 | 9/2004 | Chen et al. |
| 2004/0209243 A1 | 10/2004 | Nixon et al. |
| 2005/0004021 A1 | 1/2005 | Sprecher et al. |
| 2005/0164928 A1 | 7/2005 | Ladner et al. |
| 2005/0164945 A1 | 7/2005 | Nixon et al. |
| 2005/0075665 A1 | 8/2005 | Golz et al. |
| 2005/0180977 A1 | 8/2005 | Nixon et al. |
| 2006/0069020 A1 | 3/2006 | Blair et al. |
| 2006/0194727 A1 | 8/2006 | Ladner et al. |
| 2006/0228331 A1 | 10/2006 | Peschke et al. |
| 2006/0264603 A1 | 11/2006 | Markland et al. |
| 2007/0020252 A1 | 1/2007 | Ladner et al. |
| 2007/0041959 A1 | 2/2007 | Ley et al. |
| 2007/0049522 A1 | 3/2007 | Ladner et al. |
| 2007/0065407 A1 | 3/2007 | Patten et al. |
| 2007/0100133 A1 | 5/2007 | Beals et al. |
| 2007/0117752 A1 | 5/2007 | Larsen et al. |
| 2007/0079096 A1 | 7/2007 | Ladner |
| 2007/0213275 A1 | 9/2007 | Clark et al. |
| 2007/0249807 A1 | 10/2007 | Ladner et al. |
| 2007/0253949 A1 | 11/2007 | Golz et al. |
| 2008/0038276 A1 | 2/2008 | Sinha et al. |
| 2008/0050716 A1 | 2/2008 | Cicardi et al. |
| 2008/0064637 A1 | 3/2008 | Ladner et al. |
| 2008/0076712 A1 | 3/2008 | Ladner et al. |
| 2008/0131426 A1 | 6/2008 | Ladner et al. |
| 2008/0139473 A1 | 6/2008 | Ladner et al. |
| 2008/0152656 A1 | 6/2008 | Ladner et al. |
| 2008/0182283 A1 | 7/2008 | Markland et al. |
| 2008/0188409 A1 | 8/2008 | Blair et al. |
| 2008/0200646 A1 | 8/2008 | Ladner et al. |
| 2008/0221031 A1 | 9/2008 | Blair et al. |
| 2008/0226655 A1 | 9/2008 | Ladner et al. |
| 2008/0255025 A1 | 10/2008 | Ladner |
| 2008/0260752 A1 | 10/2008 | Ladner et al. |
| 2008/0299050 A1 | 12/2008 | Bortz et al. |
| 2009/0023651 A1 | 1/2009 | Markland et al. |
| 2009/0062195 A1 | 3/2009 | Ladner et al. |
| 2009/0075887 A1 | 3/2009 | McPherson |
| 2009/0082267 A1 | 3/2009 | Ladner et al. |
| 2009/0105142 A1 | 4/2009 | Moscicki |
| 2009/0117130 A1 | 5/2009 | Ladner et al. |
| 2009/0123475 A9 | 5/2009 | Siegel |
| 2009/0215119 A1 | 8/2009 | Ladner |
| 2009/0221480 A1 | 9/2009 | Blair et al. |
| 2009/0227494 A1 | 9/2009 | Blair et al. |
| 2009/0227495 A1 | 9/2009 | Blair et al. |
| 2009/0233852 A1 | 9/2009 | Blair et al. |
| 2009/0234009 A1 | 9/2009 | Blair et al. |
| 2009/0247452 A1 | 10/2009 | Ellis et al. |
| 2009/0247453 A1 | 10/2009 | Blair et al. |
| 2009/0264350 A1 | 10/2009 | Blair et al. |
| 2010/0034805 A1 | 2/2010 | Ladner et al. |
| 2010/0183625 A1 | 7/2010 | Sternlicht |
| 2010/0273721 A1 | 10/2010 | Belichard |
| 2010/0286061 A1 | 11/2010 | Devy et al. |
| 2011/0008762 A1 | 1/2011 | Cicardi et al. |
| 2011/0136746 A1 | 6/2011 | Markland et al. |
| 2011/0200611 A1 | 8/2011 | Sexton |

(56) References Cited

U.S. PATENT DOCUMENTS

| | | |
|---|---|---|
| 2012/0201756 A1 | 8/2012 | Sexton |
| 2012/0328517 A1 | 12/2012 | Markland et al. |
| 2013/0012438 A1 | 1/2013 | Blair et al. |

FOREIGN PATENT DOCUMENTS

| | | |
|---|---|---|
| DE | 69533472 T2 | 1/2006 |
| EP | 0255011 A2 | 2/1988 |
| EP | 0274826 A1 | 7/1988 |
| EP | 0285123 A2 | 10/1988 |
| EP | 301122 A1 | 2/1989 |
| EP | 0318451 A2 | 5/1989 |
| EP | 0621870 B1 | 11/1994 |
| EP | 0621871 B1 | 11/1994 |
| EP | 739355 B1 | 10/1996 |
| EP | 1484339 A2 | 12/2004 |
| JP | 7-504891 T | 6/1995 |
| JP | 9-059838 A | 3/1997 |
| JP | 9-511131 T | 11/1997 |
| JP | 10-503375 A | 3/1998 |
| JP | 2002-524076 T | 8/2002 |
| WO | 89/10374 A1 | 11/1989 |
| WO | 902809 A1 | 3/1990 |
| WO | 92/06111 A1 | 4/1992 |
| WO | 93/09233 A2 | 5/1993 |
| WO | 93/14120 A1 | 7/1993 |
| WO | 93/14121 A1 | 7/1993 |
| WO | 93/14122 A1 | 7/1993 |
| WO | 9314120 A1 | 7/1993 |
| WO | 9314121 A1 | 7/1993 |
| WO | 9314122 A1 | 7/1993 |
| WO | 95/18830 A2 | 7/1995 |
| WO | 95/21601 A2 | 8/1995 |
| WO | 9521601 A2 | 8/1995 |
| WO | 95/23860 A3 | 9/1995 |
| WO | 96/04378 A3 | 3/1996 |
| WO | 9620278 A2 | 7/1996 |
| WO | 96/35788 A2 | 11/1996 |
| WO | 9733996 A2 | 9/1997 |
| WO | 98/52976 A1 | 11/1998 |
| WO | 9963090 A2 | 12/1999 |
| WO | 00/14235 A1 | 3/2000 |
| WO | 00/34317 A2 | 6/2000 |
| WO | 0109968 A1 | 2/2001 |
| WO | 0114424 A2 | 3/2001 |
| WO | 0168707 A1 | 9/2001 |
| WO | 0179480 A1 | 10/2001 |
| WO | 0206334 A1 | 1/2002 |
| WO | 0206539 A1 | 1/2002 |
| WO | 02092147 A2 | 11/2002 |
| WO | 02094200 A2 | 11/2002 |
| WO | 03006860 A1 | 1/2003 |
| WO | 03066824 A2 | 8/2003 |
| WO | 03/103475 A2 | 12/2003 |
| WO | 2004/019968 A1 | 3/2004 |
| WO | 2004/062646 A1 | 7/2004 |
| WO | 2004/062689 A1 | 7/2004 |
| WO | 2005/021557 A2 | 3/2005 |
| WO | 2005021556 A2 | 3/2005 |
| WO | 2005021557 A2 | 3/2005 |
| WO | 2005/075665 A2 | 8/2005 |
| WO | 2006/017538 A2 | 2/2006 |
| WO | 2006036860 A2 | 4/2006 |
| WO | 2006/066878 A1 | 6/2006 |
| WO | 2006/089005 A2 | 8/2006 |
| WO | 2007079096 A2 | 7/2007 |
| WO | 2007106746 A2 | 9/2007 |
| WO | 2008000833 A1 | 1/2008 |
| WO | 2009/026334 A2 | 2/2009 |
| WO | 2009026539 A1 | 2/2009 |
| WO | 2009/102927 A1 | 8/2009 |
| WO | 2010003475 A2 | 1/2010 |
| WO | 2010006746 A2 | 1/2010 |
| WO | 2011/085103 A2 | 7/2011 |
| WO | 2012/094587 A1 | 7/2012 |

OTHER PUBLICATIONS

Girard et al., "Functional Significance of the Kinitz-type Inhibitory Domains of Liporotein-Associated Coagulation Inhibitor," Nature, 338:518-520 (1989).

Girard, et al., "Structure of the Human Lipoprotein-associated Coagulation Inhibitor Gene," The Journal of Biological Chemistry, 266:5036-5041 (1991).

Gonzalez-Quevedo et al., The Synthetic Kinitz Domain Protein DX88 to Treat Angiodema in Patients with Hereditary Angiodema, International Immunopharmacology 2(9):1318 Abstract 205 (2005).

Han, Eun D. et al., Increased Vascular Permeability in C1 Inhibitor-Deficient Mice Mediated by the Bradykinin Type 2 Receptor, J. Clinical Investigation 109(8):1057-1063 (2002).

Han, Eun D. Reversal of the Increased Vascular Permeability in C1 Inhibitor Deficient Mice: Therapeutic Approaches, International Immunopharmacology 2(9):1315 Abstract 176 (2002).

Hoover, et al., "Amino Acids of the Recombinant Kringle 1 Domain of Human Plasminogen that Stabilize Its Interaction w-Amino Acids," Biochemistry, 32:10936-10943 (1993).

Hortin, et al., "Allosteric Changes in Thrombin's Activity Produced by peptides Corresponding to Segments of Natural Inhibitors ans Substrates," The Journal of Biological Chemistry, 266:6866-6871 (1991).

Hostomsky, et al., "Solid Phase Assembly of Cow Colostrum Trypsin Inhibitor Gene," Nucleic Acids Research, 15:4849-4856 (1987).

Hynes et al., "X-Ray Crystal Structure of the Protease Inhibitor Domain of Alzheimer's Amyloid, ?-Protein Precursor," Biochemistry, 29:10018-10022 (1990).

International Search Report dated Jun. 1, 2010 for Application No. PCT/US2010/020257.

International Search Report received in PCT/US07/63703, dated Dec. 21, 2007.

Kemp et al., "Synthesis of Peptide-Functionalized Daicylaminoepinodolidiones," Tetrahedron Letters, 29:5077-5080 (1988).

Kido et al., "Kunitz-type Protease Found in Rat Mast Cells," J. Biol. Chem. 263(34):18104-18107 (1988).

Kido et al., "Protease Specificity of Kunitz Inhibitor Domain of Alzheimer's Disease Amyloid Protein Precursor," Biochemical and Biophysical Research Communications, 167:716-721 (1990).

Kirchoff, et al., "A Major Human Epididymis-Specific cDNA Encodes a Protein with Sequence Homology to Extracellular Proteinase Inhibitors," Biology of Reproduction, 45:350-357 (1991).

Kline, et al., "Hirulog Peptides with Scissile Bond Replacements Resistant to Thrombin Cleavage," Biochem. Biophys. Res. Comm., 177:1049-1055 (1991).

Kurjan & Herskowitz, "Structure of a Yeast Pheromone Gene (MF?): A putative ?-Factor Precursor Contains Four Tandem Copies of Mature ?-Factor," Cell, 30: 933-943 (1982).

Laskowski, et al., "Inhibitors with Class-Specific Reactive Sites," Ann. Rev. Biochem., 49:593-626 (1980).

Leatherbarrow, et al., "Design of a Small Peptide-Based Proteinase Inhibitor by Modeling the Active-Site Region of Barley Chymotrypsin Inhibitor 2," Biochemistry, 30:10717-10721 (1991).

Ley et al., "Obtaining a Family of High-Affinity, High Specificity Protein Inhibitors of Plasmin and Plasma Kallikrein," Molecular Diversity, 2:119-124, (1996).

Lohmann, et al., Plasmin- and Plasminogen-Activator Inhibitors after Excimer Laser Photorefractive Keratectomy: New Concept in Prevention of Postoperative Myopic Regression and Haze, Refractive and Corneal Surgery, 9:300-302, (1993).

Lucas, et al., "The Binding of Human Plasminogen to Fibrin and Fibrinogen," J. Biol. Chem., 258:4249-4256 (1983).

Lumry et al, Interim Results of EDEMA2, A Multicenter, Open-Label, Repeat-Dosing Study of Intravenous and Subcutaneous Administration of Ecallantide (DX-88) in Hereditory Angioedema. J. Allergy and Clinical Immunology 117(2)(Suppl. 1):S179 Abstract 699 (2006).

(56) References Cited

OTHER PUBLICATIONS

MacGilchrist, "Effect of the Serine Protease Inhibitor, Aprotinin, on Systemic Haemodynamics and Renal Function in Patients with Hepatic Cirrhosis and Ascites," Clin. Sci., 87:329-335 (1994).

Mann et al., Hemostasis and Thrombosis, Chapter 10, 2nd Edition, Basic Principles and Clinical Practice: 148-161 (1987).

March, Advanced Organic Chemistry, 3rd Edition, Reactions, Mechanisms, and Structure, John Wiley and Sons, New York: 396-398; 1057-1060; 1099-1100 (1985).

Markland et al., "Iterative Optimization of High-Affinity Protease Inhibitors Using Phage Display. 1. Plasmin," Biochemistry, 35:8045-8057 (1996).

Markland et al., "Iterative Optimization of High-Affinity Protease Inhibitors Using Phage Display. 2. Plasma Kallikrein and Thrombin," Biochemistry 35(24):8058-67 (1996).

Markland et al., "Selection for Protease Inhibitors Using Bacteriophage Display," Methods Enzymol., 267:28-51 (1996).

Mathews, C.K., et al., Biochemistry, The Benjamin Cummins Publishing Co., Inc. Redwood City CA: 208-212 (1990).

McConnell et al., "New Leupeptin Analogues: Synthesis and Inhibition Data," J. Med. Chem., 33:86-93 (1990).

Merrifield, "Solid Phase Peptide Synthesis. I. The Synthesis of a Tetrapeptide," Am. Chem. Soc. 85:2149-2154 (1963).

Merrifield, "Solid Phase Synthesis," Science, 232:341-347 (1986).

Miyajima, et al., Secretion of Mature Mouse Interleukin-2 by Saccharomyces Cerevisiae: Use of a General Secretion vector Containing Promoter and Leader Sequences of the Mating Pheromone ?-factor, Gene, 37:155-161 (1985).

Monteseirin, et al., "Plasma Kallikrein Amidolytic Activity in Bronchial Asthma," Allergol. Immunopathol., (Madr)., 20:211-214 (1992).

Naess, et al., "Effects of a Combined Drug Regimen on Tumour Necrosis Factor and Plasma Kallikrein Activity in Experimental Endotoxaemia," Eur. J. Surg., 160:77-86 (1994).

Nagai et al., "Synthesis of a Bicyclic Dipeptide with the Shape of ?-Turn Central Part," Tetrahedron Letters, 26 (5):647-650 (1985).

Nagai, et al., Bicyclic Turned Dipeptide (BTD) as a ?-Turn Mimetic; its Design, Synthesis, and Incorporation into Bioactive Peptides, Tetrahedron, 49:3577-3592 (1993).

Neuhaus, et al., "Effect of Aprotinin on Intraoperative Bleeding and Fibrinolysis in Liver Transplantation," Lancet, 2: 924-925 (1989).

Ngo, et al., "Computational Complexity, Protein Structure Prediction, and the Levinthal Paradox", The Protein Folding Problem and Tertiary Structure Prediction, Chapter 14, pp. 433-440 and 492-495 only (1994).

Novotney et al., "Purification and Characterization of the Lipoprotein-associated Coagulation Inhibitor from Human Plasma," J. Biol. Chem. 264:18832-18837 (1989).

O'Reilly, et al., "Angiostatin: A Novel Angiogenesis Inhibitor That Mediates the Suppression of Metases by a Lewis Lung Carcinoma," Cell, 79 317-328 (1994).

Okamoto, et al., "A Finding of Highly Selective Synthetic Inhibitor of Plasma Kallikrein; Its Action to Bradykinin Generation, Intrinsic Coagulation and Experimental DIC," Agents Actions Suppl., 38(I):198-205 (1992).

Park, et al., "Three Dimensional Structure of the Kringle Sequence: Structure of Prothrombin Fragment 1," Biochemistry, 25:3977-3982 (1986).

PCT International Search Report dated Jul. 21, 2008 and issued in PCT/US05/34335.

PCT Written Opinion dated Jul. 21, 2008 and issued in PCT/US05/34335.

Putterman, C., "Aprotinin Therapy in Septic Shock," ACTA Chir. Scand., 155:367 (1989).

Robbins, K.C. et al., Hemostasis and Thrombosis, Chapter 21, 2nd Edition, Basic Principles and Clinical Practice: 340-357 (1987).

Rossi, E. et al., The Synthetic Peptide DX88 Binds to Endothelial Cells in Vitro and Retains the Inhibitory Activity on Kallikrein, International Immunopharmacology 2(9):1313, Abstract 142 (2002).

Sartor, R.B., et al., "Selective Kallikrein-Kinin System Activation in Inbred Rats Differentially Susceptible to Granulomatous Enterocolitis," Gastroenterology, 110:1467-1481 (1996).

Scatchard, George, The Attractions of Proteins for Small Molecules and Ions, Ann. NY Acad. Sci, 51:660-672 (1949).

Schecther et al, On the Active Site of Proteases, III Mapping the Active Site of Papain; Specific Peptide Inhibitors of Papain, Biochemical and Biophysical Research Communications 32(5):898-902 (1968).

Schecther et al., On the Size of the Active Site on Proteases, I Papain, Biochemical and Biophysical Research Communications 27(2):157-162 (1967).

Schmaier et al., Hemostasis and Thrombosis, Chapter 2, 2nd Edition, Basic Principals and Clinical Practice: 18-38 (1987).

Schmidt et al., "A male accessory gland peptide with protease inhibitory activity in Drosophila funebris," Swiss-Prot, Accession #P11424 (1992).

Schnabel et al., Aprotinin: Preparation by Partial Desulphurization of Aprotinin by Means of Raney Nickel and Comparison with Other Aprotinin Derivatives, Biol. Chem. Hoppe-Seyler, 367:1167-1176 (1986).

Sheppard, et al., Acid-Labile Resin Linkage Agents for Use in Solid Phase Peptide Synthesis, Int. J. Peptide Protein Res., 20:451-452 (1982).

Sheridan, et al., A Multicenter Trial of the Use of the Proteolytic Enzyme Inhibitor Aprotinin in Colorectal Surgery, Dis. Colon Rectum, 32:505-508 (1989).

Skolnick and Fetrow, From Genes to Protein Structure and Function: Novel Applications of Computational Approaches in the Genomic Era; Trends in Biotechnology, vol. 18, pp. 34-39 (2000).

Sprecher et al., "Molecular Cloning, Expression, and Partial Characterization of a Second Human Tissue-Factor-Pathway Inhibitor," Proc. Natl. Acad. Sci. USA, 91:3353-3357 (1994).

Stadnicki et al., "Activation of the Kallikrein-Kinin System in Indomethacin-Induced Entercolitis in Genetically Suseprible Rats," J. Invest. Med., 44:299A (1996).

Stadnicki et al., "Selective Plasma Kallikrein Inhibitor Attenuates Acute Intestinal Inflammation in Lewis Rat," Dig. Dis. Sci., 41:912-920 (1996).

The Merck Index: 145, 263, 427, 428, 1183, and 1184 (1989).

Tian et al., "Synthesis of Optically Pure C?-methyl-arginine," Int. J. Peptide Res., 40:119-126 (1992).

Van der Logt et al., "Intron-Exon Organization of the Human Gene Coding for the Lipoprotein-associated Coagulation Inhibitor: The Factor Xa Dependent of Inhibitor of the Extrinsic Pathway of Coagulation," Biochemistry, 30:1571-1577 (1991).

Van Dijl et al., "Signal Peptidase 1 of Bacillus subtillis: Patterns of Conserved Amino Acids in Prokaryotic and Eukaryotic Type 1 Signal Peptidases," The EMBO Journal, 11:2819-2828 (1992).

Varadi et al., "Location of Plasminogen-Binding Sites in Human Fibrin(ogen)," Biochemistry, 22:2440-2446 (1983).

Varadi, et al., Segment of Fibrinogen is in a Region Essential for Plasminogen Binding by Fibrin Fragment E, Biochemistry, 23:2108-2112 (1984).

Vedvick, et al., "High-Level Secretion of Biologically Active Aprotinin from the Yeast Pichia Pastoris," J. Ind. Microbiol., 7:197-201 (1991).

Viswanathan M. et al., "Engineered protein protease inhibitors", Current Enzyme Inhibition, Jan. 1, 2009, pp. 87-98, vol. 5, No. 2, Betham Science Publishers Ltd., Hilversum, NL.

Wade, et al., "Solid-Phase Synthesis of ?-Human Atrial Natriuretic Factor: Comparison of the Boc-Polystyrene and Fmoc-Polyamide Methods," Biopolymers, 25: S21-S37 (1986).

Wagner et al., High Level Expression, Purification, and Characterization of the Kunitz-Type Protease Domain of Protease Nexin-2/Amyloid ?-Protein Precursor, Biochemical and Biophysical Research Communications, 186: 1138-1145 (1992).

Wells, "Addivity of Mutational Effects in Proteins", Biochemistry, vol. 29 (37), pp. 8509-8517 (1990).

Wendel et al., Lower Cardiac Troponin T Levels in Patients Undergoing Cardiopulmonary Bypass and Receiving High-Dose Aprotinin

(56) References Cited

OTHER PUBLICATIONS

Therapy Indicate Reduction of Perioperative Myocardial Damage; Journal of Thoracic Cardiovascular Surgery, vol. 109, No. 6, pp. 1164-1172 (1995).
Wilson, et al., "The Calculation and Synthesis of a Template Molecule," Tetrahedron, 49:3655-3663 (1993).
Wood, "Hemostatic Drugs" New England Journal of Medicine, Drug Therapy, 339(4):245-253 (1998).
Worthy, K. et al., "Kallikreins and Kinins: Mediators in Inflammatory Joint Disease?", International Review of Experimental Pathology, Aug. 1, 1990, pp. 587-601, vol. 71, No. 4, Blackwell Scientific, Oxford GB.
Wun et al., "Cloning and Characterization of a cDNA Coding for the Lipoprotein-associated Coagulation Inhibitor Shows that it Consists of Three Tandem Kunitz-type Inhibitory Domains," J. Biol. Chem. 263:6001-6004 (1988).
Adelman, et al., Proteolysis of Platelet Glycoprotein Ib by Plasmin ss Facilitated by Plasmin Lysine-Binding Regions, Blood, vol. 68 (6): 1280-1284, (Dec. 1986).
Albrecht, et al., Kunitz-Type Proteinase Inhibitors Derived by Limited Proteolysis of the Inter-?-Trypsin Inhibitors From several Mammalian Sera, Hoppe-Seyler's Z. Physiol. Chem., vol. 364: 1703-1708, (Dec. 1983).
Albrecht, et al.., Elastase Inhibition by the Inter-?-Trypsin Inhibitor and Derived Inhibitors of Man and Cattle, Hoppe-Seyler's Z. Physiol. Chem., vol. 364: 1697-1702, (Dec. 1983).
Anba, et al., Improving the Stability of a Foreign Protein in the Periplasmic Space of *Escherichia coli*, Biochimie, vol. 70(6): 727-733, (1988).
Angliker, et al., The Synthesis of Lysylflouromethanes and their Properties as Inhibitors of Trypsin, Plasmin and Cathepsin B, Biochemistry, 241:871-875, (1987).
Atherton, et al., Peptide Synthesis. Part 2. Procedures for Solid Phase Synthesis using N?-Fluorenylmethycarbonylamino-acids on Polyamide Supports. Synthesis of Substance P and of Acyl Carrier Protein 65-74 Decapeptide, J. Chem. Soc. Perkins Trans, 1:538-546, (1981).
Attwood, The Babel of Bioinformatics; Science, vol. 290, pp. 471-473 (2000).
Auerswald et al., Expression, Isolation and Characterization of Recombinant [Arg15, Glu52] Aprotinin, Bio. Chem. Hoppe-Seyler, 369:(Suppl)27-35 (1988).
Baba, M et al., States of Tyrosyl Residues and Circular Dichroism of Kunitz Trypsin Inhibitor, J. Biochem 65 (1):113-121 (1969).
Balduyck, et al., Human Urinary Proteinase Inhibitor: Inhibitory Properties and Interaction with Bovine Trypsin, Bio. Chem. Hoppe-Seyler, vol. 366: 9-14, (1985).
Baneyx et al., Construction and Characterization of *Escherichia coli* Strains Deficient in Multiple Secreted Proteases: Protease III Degrades High-Molecular-Weight Substrates in Vivo, J Bacteriol., 173:2696-2703 (1991).
Baneyx et al., "In Vivo Degradation of Secreted Fusion Proteins by the *Escherichia coli* Outer Membrane Protease OmpT", J. Bacteriol., 172:491-494, (1990).
Bayes et al., "Gateways to Clinical Trials" Methods Find Exp. Clin. Pharmacol., vol. 28(3): pp. 185-206 (2006).
Berndt, et al.,"Designed Replacement of an Internal Hydration Water Molecule in BPTI: Structural and Functional Implications of a Glycine-to-Serine Mutation," Biochemistry, 32: 4564-4570 (1993).
Bhoola et al., "Bioregulation of Kinins: Kallikreins, Kininogens and Kininases," Pharmacological Reviews, 44 :1-80 (1992).
Blaber et al., "Targeting kallikrein 6-proteolysis attenuates CNS inflammatory disease," The FASEB Journal, express article published online Mar. 19, 2004.
Bork, "Powers and Pitfalls in Sequence Analysis: The 70% Gurdle", Genome Research, vol. 10, pp. 398-400 (2000).
Brenner, "Errors in genome annotation" Trends in Genetics, vol. 15 (4), pp. 132-133 (1999).

Browne et al., "Expression of Recombinant Human Plasminogen and Aglycoplasminogen in HeLa Cells," Genebank, Accession No. M74220 (1991).
Broze et al., "Regulation of Coagulation by a Multivalent Kunitz-Type Inhibitor," Biochemistry, 29:7539-7546, (1990).
Brus et al., "Disease Severity is Correlated with Plasma Clotting and Fibrinolytic and Kinin-Kallikrein Activity in Neonatal Respiratory Distress Syndrome," Pediatric Research, 41:120-127, (1997).
Budavari, ed., Merck index, 11th ed., ISBN 911910-28-X, entries 923, 1745, 2740, 7425, (1989).
Carey et al., Advanced Organic Chemistry, 3rd Edition, Part B: Reactions and Synthesis, Plenum Press, New York: 678-686 (1990).
Carpenter J.F. et al: "Rational Design of Stable Lyophilized Protein Formulations: Theory and Practice", Pharmaceutical Biotechnology, Kluwer, Dordrecht, NL, vol. 13, Jan. 1, 2002, pp. 109-133.
Chen et al., "Refined 2-5 A X-ray Crystal Structure of the Complex Formed by Porcine Kallikrein A and the Bovine Pancreatic Trypsin Inhibitor—Crystallization, Patterson Search, Structure Determination, Refinement, Structure and Comparison with its Components and with the Bovine Trypsin-Pancreatic Trypsin Inhibitor Complex" J. Mol. Biol., 164:283-311 (1983).
Chen et al., Solution Structure of a Kunitz-type Chymotrypsin Inhibitor Isolated from the Elapid Snake Bungarus Fasciatus, J. Biological Chemistry 276:45079-45087 (2001).
Chung et al., GenBank, Accession #P03952 (1986).
Colman et al., Hemostasis and Thrombosis Basic Principles and Clinical Practice, Chapter 1, 2nd Edition, 3-17 (1987).
Colman et al., "The Plasma Kallikrein-Kinin System in Sepsis, Inflammatory Arthritis, and Enterocolitis" Clinical Reviews in Allergy and Immunology, vol. 16, pp. 365-384 (1998).
Colman R. W., "Plasma and tissue Kallikrein in Arthritis and Inflammatory Bowel Disease", Immunopharmacology, Jan. 1, 1999, pp. 103-108, vol. 43, No. 2/03, Elsevier Science Publishers, BV.
Colman RW et al., "Activation of the kallikrein-kinin system in arthritis and enterocolitis in genetically susceptible rats: modulation by a selective plasma kallikrein inhibitor", Proceedings of the Association of American Physicians, Jan. 1, 1997, pp. 10-22, vol. 109, No. 1, Cambridge, MA US.
Communication received in EP Patent Application 03757339.1, dated Apr. 23, 2008.
Communication received in EP Patent No. 1 484 339, dated Sep. 29, 2005.
Cumming et al., "Hemodynamic, Renal, and Hormonal Aprotinin in an Ovine Model of Septic Shock," Critical Care Medicine, 20:1134-1139 (1992).
Currie et al., "Design and Synthesis of a Bicyclic Non-Peptide ?-Bend Mimetic of Enkephalin," Tetrahedron, 49:3489-3500 (1993).
Dela Cadena et al., "Role of Kallikrein-Kinin System in the Pathogenesis of Bacterial Cell Wall-Induced Inflammation and Enterocolitis," Transact. Assoc. Am. Physicians, 105:229-237 (1992).
Dela Cadena, et al., "Inhibition of Plasma Kallikrein Prevents Peptidoglycan-Induced Arthritis in the Lewis Rat," FASEB Journal, 9:446-452 (1995).
Dennis & Lazarus, "Kunitz Domain Inhibitors of Tissue Factor-Factor VIIa (I. Potent Inhibitors Selected from Libraries by Phage Display)," Journal of Biological Chemistry 269:22129-22136 (1994).
Dennis & Lazarus, "Kunitz Domain Inhibitors of Tissue Factor-Factor VIIa (II. Potent and Specific Inhibitors by Competitive Phage Selection)," Journal of Biological Chemistry, 269:22137-22144 (1994).
Dennis et al., "Potent and Selective Kunitz Domain Inhibitors of Plasma Kallikrein Designed by Phage Display," J. Biol. Chem., 270:25411-25417 (1995).
Diaz et al., "The Design of Water Soluble ?-Sheet Structure Based on a Nucleation Strategy," Tetrahedron, 49:3533-3534 (1993).
Dimaio et al., "A New Class of Potent Thrombin Inhibitors That Incorporates a Scissile Pseudopeptide Bond," FEBS Lett., 282(1):47-52 (1991).
Doerks, et al., "Protein annotation: detective work for function prediction", Trends in Genetics, vol. 14 (6), pp. 248-250 (1998).

(56) References Cited

OTHER PUBLICATIONS

Eigenbrot et al. "Structural Effects Induced by Removal of a Disulfide-Bridge: The X-ray Structure of the C30A/C51A Mutant of Basic Pancreatic Trypsin Inhibitor at 1.6 A," Protein Engineering, 3:591-598 (1990).

Ellis et al., "The Urokinase Receptor: Involvement in Cell Surface Proteolysis and Cancer Invasion," Ann. NY. Acad. Sci., 667:13-31 (1992).

Extended European Search Report dated Apr. 1, 2009 from EP Application No. 08018863.4, which includes the European Search Report and the European Search Opinion.

Extended European Search Report from European Application Serial No. 08798517.2 dated Nov. 2, 2010.

Extended European Search Report from European Application Serial No. 10180484.7 dated Mar. 9, 2011.

Extended European Search Report from European Application Serial No. 10180486.2 dated Feb. 23, 2011.

Fidler & Ellis, "The Implications of Angiogenesis for the Biology and Chemistry of Cancer Metastasis," Cell, 79:185-188 (1994).

Adams et al: "The role of viscosupplementation with hylan G-F 20 (Synvisc(R)) in the treatment of osteoarthritis of the knee: a Canadian multicenter trial comparing hylan G-F 20 alone, hylan G-F 20 with non-steroidal anti-inflammatory inflammatory drugs (NSAIDs) and NSAIDs alone", Osteoarthritis and Cartilage, Bailliere Tindall, London, GB, vol. 3, No. 4, pp. 213-225, (Dec. 1, 1995).

Alberto Migliore et al: "Open pilot study of ultrasound-guided intra-articular injection of hylan G-F 20 (Synvisc) in the treatment of symptomatic hip osteoarthritis", Clinical Rheumatology; Journal of the International League of Associations for Rheumatology, Springer-Verlag, LO, vol. 24, No. 3, pp. 285-289 (Jun. 1, 2005).

Asano M. et al., "Effects of a nonpeptide bradykinin B2 receptor antagonist, FR167344, on different in vivo animal models of inflammation", Br J Pharmacol, vol. 122, p. 1436-1440 (1997).Asano M. et al., Br J Pharmacol, vol. 122, p. 1436-1440 (1997).

Beckmann et al., "Preparation of chemically 'mutated' aprotinin homologues by semisynthesis-P1 substitutions change inhibitory specificity," Eur. J. Biochem., vol. 176, pp. 675-682 (1988).

Berge, S.M., et al., "Pharmaceutical salts", J. Pharm. Sci. 66:1-19 (1977).

Bergthorsdottir et al., "Signals that initiate somatic hypermutation of B cell in vitro", J. Immunol., p. 166:2228 (2001).

Bowdish K, et. al., "Yeast expression of a catalytic antibody with chorismate mutase activity.", J Biol Chem.; 266 (18):11901-8 (Jun. 25, 1991).

Brinkmann et al., "Design of an aprotinin variant with inhibitory activity against chymotrypsin and cathepsin G by recombinant DNA technology," Biol. Chem. Hoppe-Seyler, vol. 371, pp. 43-52 (1990).

Buchan et al., "A new model of temporary focal neocortical ischemia in the rat", Stroke 23 (2): 273-9 (1992).

Carmichael, "Rodent models of focal stroke: size, mechanism, and purpose", NeuroRx 2: 396-409 (2005).

Casati et al., "Cardiopulmonary support and physiology—tranexamic acid compared with high-dose aprotinin in.primary elective heart operations: effects on perioperative bleeding and allogeneic transfusions," The Journal of Thoracic and Cardiovascular Surgery, vol. 120, pp. 520-527 (2000).

Cernak, "Animal models of head trauma", NeuroRx. 2(3): 410-422 (2005).

Chen et al., "A model of focal ischemic stroke in the rat: reproducible extensive cortical infarction", Stroke 17 (4): 738-43 (1986).

Chen et al., "Establishment of an animal model of oral mucositis induced by conditioning regimen of haematopoietic stem cell transplantation" Zhonghua Kou Qiang Yi Xue Za Zhi. 42(11):672-6 (2007). (Abstract only).

Colman, et al., "Contact System: A Vascular Biology Modulator With Anticoagulant, Profibrinolytic, Antiadhesive, and Proinflammatory Attributes" Blood, 90, 3819-3843 (1997).

Communication received in EP Patent Application 03791557.6, dated Nov. 27, 2008.

De Haard, et al. "A large non-immunized human Fab fragment phage library that permits rapid isolation and kinetic analysis of high affinity antibodies". J. Biol. Chem 274:18218-30, (1999).

De Wildt, et al., "Characterization of human variable domain antibody fragments against the U1 RNA-associated A protein, selected from a synthetic and patient-derived combinatorial V gene library" Eur J Immunol. 26(3):629-39 (1996).

Deng , et. al., "Production of recombinant humanized anti-HBsAg Fab antibody by fermentation" Sheng Wu Gong Cheng Xue Bao, 20(5):800-4 (Sep. 2004) (Abstact Only).

Dittmar et al., "External carotid artery territory ischemia impairs outcome in the endovascular filament model of middle cerebral artery occlusion in rats" Stroke 34: 2252-7 (2003).

Dragosits, et. al., "The response to unfolded protein is involved in osmotolerance of Pichia pastoris" BMC Genomics. Mar. 26, 2010;11:207.

Dufton, "Protein inhibitors and dendrotoxins," Eur. J. Biochem., vol. 153, pp. 647-654. (1985).

European Communication from European Application No. 03791557.6, dated Oct. 29, 2007.

Extended European Search Report dated Feb. 14, 2012 for PCT/US2008/073665.

Extended European Search Report dated Oct. 1, 2010 from European Application Serial No. 10164197.5.

Extended European Search Report for European Application Serial No. 10180486.2 dated Feb. 15, 2011.

Extended European Search Report for PCT/US2008/074061 dated Nov. 2, 2010.

Extended European Search Report from European Application No. 07758271.6 dated Jun. 24, 2010.

Fife, et al, "Cartilage matrix glycoprotein is present in serum in experimental canine osteoarthritis" J Clin Invest. 84(5): 1432-1439 (1989).

Frisbie, "An animal model for venous thrombosis and spontaneous pulmonary embolism." Spinal Cord 43, 635-639 (2005).

Galeffi, et. al., "Functional expression of a single-chain antibody to ErbB-2 in plants and cell-free systems" J Transl Med. Sep. 29, 2006;4:39.

Gerriets et al., "Complications and pitfalls in rat stroke models for middle cerebral artery occlusion: a comparison between the suture and the macrosphere model using magnetic resonance angiography", Stroke 35: 2372-2377 (2004).

Goldenberg et al., "Circular and circularly permuted forms of bovine pancreatic trypsin inhibitor," J. Mol. Biol., vol. 165, pp. 407-413 (1983).

Graham et al., "Animal models of ischemic stroke: balancing experimental aims and animal care", Comp Med 54: 486-496 (2004).

Greilich et al., "Antigibrinolytic therapy during cardiopulmonary bypass reduces proinglammatory cytokine levels: a randomized, double-blind, placebo-controlled study of x-aminocaproic acid and aprotinin," J. Thorac. Cardiovasc. Surg., 2003, vol. 126, pp. 1498-1503.

Grimaldi et al., "Trasylol in the treatment of acute arthritis due to microcrystals," Reumatismo, vol. 23, No. 5, pp. 217-221, (1971) (Abstract only).

Guzman et al. "Mono-iodoacetate-induced histologic changes in subchondral bone and articular cartilage of rat femorotibial joints: an animal model of osteoarthritis." Toxicol Pathol. 31(6):619-24 (2003).

Hanes et al., "Picomolar affinity antibodies from a fully synthetic naive library selected and evolved by ribosome display" Nat Biotechnol. 18:1287-92 (2000).

Hoet, et al., "Generation of high-affinity human antibodies by combining donor-derived and synthetic complementarity-determining-region diversity" Nat Biotechnol. 23(3)344-8 (2005).

Hoogenboom et al. "Natural and designer binding sites made by phage display technology" Immunol Today 2:371-8 (2000).

Hoogenboom et al., "Antibody phage display technology and its applications" Immunotechnology 4:1-20 (1998).

Horwitz, et. al., "Secretion of functional antibody and Fab fragment from yeast cells.", Proc Natl Acad Sci U S A. 85 (22):8678-82 (Nov. 1988).

Huge et al. "A model to investigate postoperative ileus with strain gauge transducers in awake rats" J Surg Res. 74 (2):112-8 (1998).

(56) References Cited

OTHER PUBLICATIONS

International Preliminary Report on Patentability from International Application No. PCT/US2008/073665 mailed Mar. 4, 2010.
International Preliminary Report on Patentability from International Application No. PCT/US2008/074061 mailed Mar. 4, 2010.
International Search Report for application PCT/US12/20470 dated Apr. 30, 2012.
International Search Report for PCT/US11/20377 dated Jun. 28, 2011.
International Search Report from international Application No. PCT/US03/17802, dated Oct. 30, 2003.
International Search Report from International Application No. PCT/US2008/074061 mailed Dec. 29, 2008.
International Search Report including Written Opinion received in PCT/08/73665, dated Feb. 5, 2008.
Shibuya, et. al., "Primary Structure of Guinea Pig Plasma Prekallikrein", Immunopharmacology, vol. 45 (1-3), p. 127-34, Abstract p. 131, Fig 1, 2 (1999).
Siebeck et al., "Inhibition of plasma kallikrein with aprotinin in porcine endotoxin shock," J. Trauma, vol. 34, pp. 193-198 (1993).
Sonis et al. "An animal model for mucositis induced by cancer chemotherapy" (1990) Oral Surg Oral Med Oral Pathol. 69:437-43.
Sonis et al. "Validation of a new scoring system for the assessment of clinical trial research of oral mucositis induced by radiation or chemotherapy. Mucositis Study Group." (1999) Cancer 85:2103-13.
Stadnicki et al., "Activation of the contact system and circulating neutrophil elastase in ulcerative colitis patients" 10th World Congress of Gastroenterology, p. 1166, 1994.
Sunkureddi et al., "Clinical signs of gout," Hospital Physician, 2006, pp. 39-41.
Supplemental European Search Report from corresponding EP Application No. 07758271.6 dated Jun. 24, 2010.
Takahashi, et al., "Production of humanized Fab fragment against human high affinity IgE receptor in Pichia pastoris" Biosci Biotechnol Biochem 64(10):2138-44 (2000).
Tamura, et al., "Focal cerebral ischaemia in the rat: 1. Description of technique and early neuropathological consequences following middle cerebral artery occlusion" J Cereb Blood Flow Metab 1: 53-60 (1981).
Tschesche et al., "Semisynthetic engineering of proteinase inhibitor homologues," Biochim. Biophys. Acta, vol. 913, pp. 97-101 (1987).
Uebel,"Die behandlung con kniegelenksarthrosen mit trasylol," Langenbacks Arch. Chir., vol. 325, pp. 356-358 (1969).
Urlaub et al., "Isolation of Chinese hamster cell mutants deficient in dihydrofolate reductase activity", Proc. Natl. Acad. Sci. USA 77:4216-4220 (1980).
Vidal et al., "Making sense of antisense," European Journal of Cancer, 2005, vol. 41, pp. 2812-2818.
Wang et al., "Monitoring of heparin-induced anticoagulation with kaolin-activated clotting time in cadiac surgical patients treated with aprotinin," Anesthesiology, vol. 77, pp. 1080-1084 (1992).
Worthy et al., "Current status review kallikreins and kinins: mediators in inflammatory joint disease," Int. J. Exp, 1990.
Written Opinion for PCT/US11/20377 dated Jun. 28, 2011.
Written Opinion from International Application No. PCT/US2008/074061 mailed Dec. 29, 2008.
XP_376532.2 (GI:51465288): "Predicted: KIAA0408", GenBank Record created on Aug. 19, 2004, GenBank [online] Bethesda, MD USA: United States National Library of Medicine, retrieved from internet using <URL:http://www.ncbi.nlm.nih.gov/protein/XP_376532.2?report=genpept> GenBank Accession No. XP_376532.2 (GI:51465288).
International Search Report including Written Opinion received in PCT/US08/74061, dated Dec. 28, 2008.
Kanppik et al., "Fully synthetic human combinatorial antibody libraries (HuCAL) based on modular consensus frameworks and CDRs randomized with trinucleotides", J. Mol. Biol. 296:57-86 (2000).
Kaplan, et. al., "A Prealbumin Activator of Preallirrein. 3. Appearance of Chemotactic Activity for Human Neutrophils by the conversion of Human Prekallikrein", J. Exp. Med. vol. 135(1), p. 81-97; p. 92 Fig 10, p. 93 (1972).
Kaufman, et al., "Amplification and expression of sequences cotransfected with a modular dihydrofolate reductase complementary dna gene", Mol. Biol. 159:601 621 (1982).
Koizumi et al., Experimental studies of ischemic brain edema. 1. A new experimental model of cerebral embolism in rats in which recirculation can be introduced in the ischemic area. Jpn J Stroke 1986;8:I-8.
Leeb-Lundberg et al. "International union of pharmacology. XLV. Classification of the kinin receptor family: from molecular mechanisms to pathophysiological consequences", (2005) Pharmacol Rev 57, 27-77.
Levy Jerrold H et al: "The therapeutic potential of a kallikrein inhibitor for treating hereditary angioedema.", Expert Opinion on Investigational Drugs Sep. 2006 LNKD-PUBMED:16916274,vol. 15, No. 9, Sep. 2006, pp. 1077-1090.
Lilla et al., "Active plasma kallikrein localizes to mast cells and regulates epithelial cell apoptosis, adipocyte differentiation, and stromal remodeling during mammary gland involution" J Biol Chem. 284(20):13792-13803 (2009).
Longa et al., "Reversible middle cerebral artery occlusion without craniectomy in rats" Stroke 20 (1): 84-91 (1989).
Markland, Cell. Biochem. Supp., 1994, O, vol. 18D, pp. 157, Abstract S 331.
Mattheakis et al. "An in vitro polysome display system for identifying ligands from very large peptide libraries" Proc. Natl. Acad. Sci. USA 91:9022 (1994).
McCarty, "Crystal-induced inflammation of the joints," Annual Reviews of Medicine, vol. 21, pp. 357-366 (1970).
Merriam-Webster reference for the term "prevent." web date: 2010. 2 pages.
Moreland, "Intra-articular hyaluronan (hyaluronic acid) and hylans for the treatment of osteoarthritis: mechanisms of action," Arthritis Res. Ther., 2003, vol. 5, pp. 54-67.
Murkin et al., "Aprotinin significantly decreases bleeding and transfusion requirements in patients receiving aspirin and undergoing cardiac operations," J. Thorac. Cardiovasc. Surg., vol. 107, pp. 554-561 (1994).
Ning, et. al., "Production of recombinant humanized anti-HBsAg Fab fragment from Pichia pastoris by fermentation.", J Biochem Mol Biol. ;38(3):294-9. (May 31, 2005).
NM_008455.2 (GI: 236465804): "Plasma kallikrein precursor", GenBank Record created on Dec. 29, 2010 GenBank [online] Bethesda, MD USA: United States National Library of Medicine, retrieved from internet using <URL:http://www.ncbi.nlm.nih.gov/nuccore/236465804?sat=14&satkey=4833839> GenBank Accession No. NM_008455.2 (GI: 236465804).
NM_012725.2 (GI:162138904): "Plasma kallikrein precursor", GenBank Record created on Dec. 26, 2010 GenBank [online] Bethesda, MD USA: United States National Library of Medicine, retrieved from internet using <URL:http://www.ncbi.nlm.nih.gov/nuccore/162138904?sat=14&satkey=5346361> GenBank Accession No. NM_012725.2 (GI:162138904).
NP_000217.2 (GI:55956899): "keratin, type I cytoskeletal 9 ", GenBank Record created on Dec. 27, 2010 GenBank [online] Bethesda, MD USA: United States National Library of Medicine, retrieved from internet using <URL:http://www.ncbi.nlm.nih.gov/protein/55956899?sat=14&satkey=4890700> GenBank Accession No. NP_000217.2 (GI:55956899).
NP_000418.2 (GI:109255251): "loricrin", GenBank Record created on Nov. 3, 2010 GenBank [online] Bethesda, MD USA: United States National Library of Medicine, retrieved from internet using <URL:http://www.ncbi.nlm.nih.gov/protein/109255251?sat=14&satkey=6156833> GenBank Accession No. NP_000418.2 (GI:109255251).
NP_000883.2 (GI: 78191798): "Plasma kallikrein preproprotein", GenBank Record created on Nov. 21, 2010 GenBank [online] Bethesda, MD USA: United States National Library of Medicine, retrieved from internet using <URL:http://www.ncbi.nlm.nih.gov/

(56) References Cited

OTHER PUBLICATIONS protein/78191798?sat=14&satkey=4530481> GenBank Accession No. NP_000883.2 (GI: 78191798).

NP_000892 (GI: 158508572): "mineralocorticoid receptor isoform 1", GenBank Record created on Dec. 27, 2010, GenBank [online] Bethesda, MD USA: United States National Library of Medicine, retrieved from internet using <URL:http://www.ncbi.nlm.nih.gov/protein/158508572?sat=14&satkey=4536058> GenBank Accession No. NP_000892.2 (GI: 158508572).

NP_005850.1 (GI:5032007): "transcriptional activator protein Pur-alpha", GenBank Record created on Dec. 28, 2010, GenBank [online] Bethesda, MD USA: United States National Library of Medicine, retrieved from internet using <URL:http://www.ncbi.nlm.nih.gov/protein/5032007?sat=14&satkey=4526134> GenBank Accession No. NP_005850.1 (GI:5032007).

NP_006228.3 (GI:110347449): "Pou domain, class 4, transcription factor 1", GenBank Record created on Dec. 27, 2010, GenBank [online] Bethesda, MD USA: United States National Library of Medicine, retrieved from internet using <URL:http://www.ncbi.nlm.nih.gov/protein/110347449?sat=14&satkey=4536081> GenBank Accession No. NP_006228.3 (GI:110347449).

NP_009060.2 (GI:22547197): "zinc finger protein ZIC 2", GenBank Record created on Dec. 24, 2010, GenBank.[online] Bethesda, MD USA: United States National Library of Medicine, retrieved from internet using <URL:http://www.ncbi.nlm.nih.gov/protein/22547197?sat=14&satkey=4290853> GenBank Accession No. NP_009060.2 (GI:22547197).

NP_031393.2 (GI:21396480): "RNA-binding protein Raly isoform 2", GenBank Record created on Dec. 25, 2010, GenBank [online] Bethesda, MD USA: United States National Library of Medicine, retrieved from internet using <URL:http://www.ncbi.nlm.nih.gov/protein/21396480?sat=14&satkey=4835374> GenBank Accession No. NP_031393.2 (GI:21396480).

NP_032481.2 (GI: 236465805): "Plasma kallikrein precursor", GenBank Record created on Dec. 29, 2010 GenBank [online] Bethesda, MD USA: United States National Library of Medicine, retrieved from internet using <URL:http://www.ncbi.nlm.nih.gov/protein/236465805?sat=14&satkey=4833839> GenBank Accession No. NP_032481.2 (GI:236465805).

NP_036857.2 (GI:162138905): "Plasma kallikrein precursor", GenBank Record created on Dec. 26, 2010 GenBank [online] Bethesda, MD USA: United States National Library of Medicine, retrieved from internet using <URL:http://www.ncbi.nlm.nih.gov/protein/162138905?sat=14&satkey=5346361> GenBank Accession No. NP_036857.2 (GI:162138905).

NP_056932.2 (GI:153791670): "Plasma kallikrein preproprotein", GenBank Record created on Dec. 27, 2010, GenBank [online] Bethesda, MD USA: United States National Library of Medicine, retrieved from internet using <URL:http://www.ncbi.nlm.nih.gov/protein/153791670?sat=14&satkey=4553701> GenBank Accession No. NP_056932.2 (GI:153791670).

NP_061856.1 (GI:9506713): "H/ACA ribonucleoprotein complex subunit 1", GenBank Record created on Dec. 24, 2010, GenBank [online] Bethesda, MD USA: United States National Library of Medicine, retrieved from internet using <URL:http://www.ncbi.nlm.nih.gov/protein/9506713?sat=14&satkey=4524138> GenBank Accession No. NP_061856.1 (GI:9506713).

NP_065104.1 (GI:9966841): "cell death regulator Aven", GenBank Record created on Dec. 26, 2010, GenBank [online] Bethesda, MD USA: United States National Library of Medicine, retrieved from internet using <URL:http://www.ncbi.nlm.nih.gov/protein/9966841sat=14&satkey=4843224> GenBank Accession No. NP_065104.1 (GI:9966841).

NP_115818.2 (GI:53829370): "neuralized-like protein 4 isoform 1", GenBank Record created on Dec. 27, 2010, GenBank [online] Bethesda, MD USA: United States National Library of Medicine, retrieved from internet using <URL:http://www.ncbi.nlm.nih.gov/protein/53829370?sat=14&satkey=4560911> GenBank Accession No. NP_115818.2 (GI:53829370).

NP_476429.2 (GI:109148552): "keratin, type II cytoskeletal 3 ", GenBank Record created on Dec. 24, 2010 GenBank [online] Bethesda, MD USA: United States National Library of Medicine, retrieved from internet using <URL:http://www.ncbi.nlm.nih.gov/protein/109148552?sat=14&satkey=6358709> GenBank Accession No. NP_NP_476429.2 (GI:109148552).

NP_631961.1 (GI:21327701): "TATA-binding protein-associated factor 2N isoform 1", GenBank Record created on Dec. 25, 2010, GenBank [online] Bethesda, MD USA: United States National Library of Medicine, retrieved from Internet using <URL: http://www.ncbi.nlm.nih.gov/protein/21327701?sat=14&satkey=4528109> GenBank Accession No. NP_631961.1 (GI:21327701).

NP_787059.2 (GI:40068462): "AT-rich interactive domain-containing protein 1B isoform 3", GenBank Record created on Mar. 4, 2010, GenBank [online] Bethesda, MD USA: United States National Library of Medicine, retrieved from Internet using <URL:http://www.ncbi.nlm.nih.gov/protein/NP_787059.2?report=genpept> GenBank Accession No. NP_787059.2 (GI:40068462).

Nwariaku, et al., "Effect of a bradykinin antagonist on the local inflammatory response following thermal injury" Burns, 22:324-327 (1996).

Pan et al., "Reperfusion inury following cerebral ischemia: pathophysiology, MR imaging, and potential therapies," Neuroradiology, 2007, vol. 49, pp. 93-102.

Phillips, "The challenge of gene therapy and DNA dellicery," J. Pharm. Pharmacology, vol. 53, pp. 1169-1174 (2001).

Pirollo et al., "Targeted delivery of small interfering RNA: approaching effective cancer therapies," Cancer Res., 2008, vol. 68, No. 5, pp. 1247-1250.

Pitt et al., "Rabbit monoarticular arthritis as a model for intra-articular drug injections. The local action of administered cortisol and a-1 proteinase inhibitor," Agents and Actions, vol. 15, No. 5-6, abstract online, retrieved from internet <URI:http://www.springerlink.com/content/j82860503948741/p> (Dec. 1984).

Rahman et al., "Identification and functional importance of plasma kallikrein in the synovial fluids of patients with rheumatoid, psoriatic, and osteoarthritis," Annals of the Rheumatic Diseases, vol. 54, pp. 345-350 (1995).

Reichert, "Technology evaluation: lumiliximab, Biogen Idec" Curr Opin Mol Ther., 6(6):675-83 (2004). (Abstract only).

Roberts et al., "Directed evolution of a protein: seleciton of potent neurtophil elastase inhibitor displayed on M13 fusion phage," PNAS USA, vol. 89, pp. 2429-2433 (1992).

Roberts et al., "Protease inhibitor display M13 phage: selection of high-affinity neurtophil elastase inhibitors," Gene, vol. 121, pp. 9-15 (1992).

Sainz I.M. et al., "Fifty years of research on the plasma kallikrein-kinin system: from protein structure and function to cell biology and in-vivo pathophysiology" Thromb Haemost 98, 77-83, 2007.

Schmaier A.H."Assembly, activation, and physiologic influence of the plasma kallikrein/kinin system" (2008) Int Immunopharmacol8, 161-165.

Schmid-Elsaesser, et al., "A critical reevaluation of the intraluminal thread model of focal cerebral ischemia: evidence of inadvertent premature reperfusion and subarachnoid hemorrhage in rats by laser-Doppler flowmetry" Stroke 29 (10): 2162-70 (1989).

Schoonooghe, et. al., "Efficient production of human bivalent and trivalent anti-MUC1 Fab-scFv antibodies in Pichia pastoris", BMC Biotechnol. Aug. 11, 2009;9:70.

Schopf, "IDEC-114 (IDEC)" Curr Opin Investig Drugs, 2(5):635-8 (2001). (Abstact only).

Schwartz et al., "Stability studies on derivatives of the bovine trypsin inhibitor," Biochemistry, vol. 26, pp. 3544-3551 (1987).

Abuchowski et al., "Alteration of immunological properties of bovine serum albumin by covalent attachment of polyethylene glycol," J. Bio. Chem., 1977, vol. 252, pp. 3578-3581.

Abuchowski et al., "Cancer therapy with chemically modified enzymers, I., Antitumor properties of polyethylene glycol-asparaginase conjugates," Cancer Biochem. Biophys., 1984, vol. 7, pp. 175-186.

(56) References Cited

OTHER PUBLICATIONS

Abuchowski et al., "Effect of covalent attachment of polyethylene glycol on immunogenicity and circulating life of bovine," J. Biol. Chem., 1977, vol. 252, pp. 3582-3586.
Basu et al., "Structure-function engineering of interferon-b-1b for improving stability, solubility, potency, immunogenicity, and pharmacokinetic properties by site-selective mono-PEGylation," Bioconjugate Chemistry, 2006, vol. 17, pp. 618-630.
Blijlevens et al: "Palifermin (recombinant keratinocyte growth factor-1): a pleiotropic growth factor with multiple biological activities in preventing chemotherapy- and radiotherapy-induced mucositis", Annals of Oncology, vol. 18, No. 5, Jan. 1, 2007, pp. 817-826.
Borregaard et al., "Granules of the human neutrophilic polymorphonuclear leukocyte," Blood, 1997, vol. 89, No. 10, pp. 3503-3521.
Branden et al., "Prediction, Engineering, and Design of Protein," Introduction to Protein Structure, 1991, pp. 247, Garland Publishing Inc., New York.
Burrage et al., "Matrix metalloproteinases: role in arthritis," Fronteirs in Bioscience, 2006, vol. 11, pp. 529-543.
Cantor et al., "Elastin and elastases in lung disease," 1989, Chapter 16, vol. II, pp. 159-168.
Cantor, J.O., et al., "Elastin and Elastases in Lung Disease", Elastin and Elastases, Chapter 16, vol. II, pp. 159-168 (1989).
Cassim et al., "Kallikrein cascade and cytokines in inflamed joints," Pharmacology and Therapeutics, 2002, vol. 94, pp. 1-34.
Churg et al., "Proteases and emphysema," Curr. Opin. Pulm. Med., 2005, vol. 11, pp. 153-159.
Colman, "Plasma and tissue kallikrein in arthritis and inflammatory bowel disease," Immunopharmacology, 1999, vol. 43, pp. 103-108.
Cunningham et al., "Structural and functional characterization of tissue factor pathway inhibitor following degradation by matrix metalloproteinase-8," Biochem. J., 2002, vol. 367, pp. 451-458.
De Campos, et al., "Antioedematogenic and antinociceptive actions of NPC 18521, a novel bradykinin B2 receptor antagonist", Eur J Pharmacol316, 277-286 (1996).
De Wildt, et al. "Antibody arrays for high-throughput screening of antibody-antigen interactions", Nat. Biotechnol. 18:989-994 (2000).
Debiopharm borchure, "Engineering protein inhibitor of human neutrophil elastase EPIO-hNE4 (DX-890)," Dated Oct. 2004, printed from www.debio.com/e/pdf/fiche_epi_hne4_e.pdf.
Dela Cadena et al., "Inhibition of plasma kallikrein prevents peptidoglycan-induced arthritis in the Lewis rat," FASEB J., 1995, vol. 9, pp. 446-452.
Delacourt et al., "Protection against acute lung injury by intravenous or intratracheal pretreatment with EPI-HNE-4, a new potent neutrophil elastase inhibitor," Am. J. Respir. Cell Mol. Biol., Mar. 26, 2002, vol. 26, No. 3, pp. 290-297.
Delaria et al., "Characterization of placental bikunin, a novel human serine protease inhibitor," J. Biological Chemistry, May 2, 1997, vol. 272, No. 18, pp. 12209-12214.
Delgado et al., "The uses and properties of PEG-linked proteins," Critical Review in Therapeutic Drug Carrier Systems, 1992, vol. 9, No. 3,4, pp. 249-304.
Devani et al., "Kallikrein-kinin system in inflammatory bowel disease: intestinal involvement and correlation with the degree of tissue inflammation," Digestive and Liver Disease, 2005, vol. 37, pp. 665-673.
Dhalluin et al., "Structural, kinetic, and thermodynamic analysis of the binding of the 40kDa PEG-interferon-a-2a and its individual positional isomers to the extracellular domain of the receptor IFNAR2," Bioconjugate Chemistry, 2005, vol. 16, pp. 518-527.
Dittmar et al., "Fischer-344 rats are unsuitable for the MCAO filament model due to their cerebrovascular anatomy" J Neurosci Methods 156: 50 (2006).
Donnelly et al., "Therapy for chronic obstructive pulmonary disease in the 21st century," Drugs, 2003, vol. 63, pp. 1973-1998.
Enzon Pharmaceuticals, Macromolecular Engineering Technologies, 2004, pp. 1-14.
Extended European Search Report and Search Opinion from European Application No. 05 799 587.0 dated Nov. 15, 2012.
Extended European Search Report from European Application No. 10 72 9465 dated Jan. 18, 2013.
Fries et al., "Inter-a-inhibitor, hyaluronan and inflammation," Acta Biochimica Polonica, 2003, vol. 50, No. 3, pp. 735-742.
G Yetkin et al: "The healing effect of TGF-[alpha] on gastric ulcer induced by acetylsalicylic acid in rats", International Journal of Pharmaceutics, vol. 277, No. 1-2, Jun. 1, 2004, pp. 163-172.
Goodson et al., "Site-directed PEGylation of recombinant interleukin-2 at its glycosylation site," Bio Technology, 1990, vol. 8, pp. 343-346.
Gulberg et al., "Biosynthesis, processing and sorting of neutrophil proteins: insight into neutrophil granule development," Eur. Journal of Haematology, 1997, vol. 58, pp. 137-153.
Hagihara et al., "Screening for stable mutants with amino acid pairs substituted for the disulfide bond between residues 14 and 38 of bovine pancreatic trypsin inhibitor (BPTI)," The Journal of Biological Chemistry, 2002, vol. 277, No. 52, pp. 51043-51048.
Herter et al., "Hepatocyte growth factor is a preferred in vitro substrate for the human hepsin, a membrane-anchored serine protease implicated in prostate and ovarian cancers," Biochem. J., 2005, vol. 390, pp. 125-136.
Huang et al., "Kinetics of factor Xa inhibition by tissue factor pathway inhibitor," The Journal of Biological Chemistry, 1993, vol. 268, No. 36, pp. 26950-26955.
Huang et al., "Novel peptide inhibitors of angiotensin-converting enzyme 2," The Journal of Biological Chemistry, 2003, vol. 278, No. 18, pp. 15532-15540.
Hynes et al., "X-ray crystal structure of the protease inhibitor domain of alzheimer's amyloid b-protein precursor," Biochemistry, 1990, vol. 29, pp. 10018-10022.
International Search report from International Application No. PCT/US2004/028256 dated 2005.
International Search Report of International Application No. PCT/US06/49322 mailed Dec. 7, 2007.
Katre et al., "Chemical modification of recombinant interleukin 2 by polyethylene glycol increases its potency in the murine Meth A sarcoma model," PNAS USA, 1987, vol. 84, pp. 1487-1491.
Katre et al., "Immunogenicity of recombinant IL-2 modified by covalent attachment of polyethylene glycol," J. Immunol., 1990, vol. 144, pp. 209-213.
Kelly et al., "Diabetes insipidus in uricase-deficient mice: a model for evaluating therapy with poly(ethylene glycol)-modified," J. Am. Soc. Nephrol., 2001, vol. 12, pp. 1001-1009.
Kido et al., "Kunitz-type protease inhibitor found in rat mast cells," The Journal of Biological Chemistry, 1988, vol. 263, No. 34, pp. 18104-18107.
Kirchhofer et al., "Hepsin activates pro-hepatocyte growth factor and is inhibited by hepatocyte growth factor activator-1B (HAI-1B) and HAI-2," FEBS Letters, 2005, vol. 579, pp. 1945-1950.
Kuno et al., "Possible involvement of neutrophil elastase in impaired mucosal repair in patients with ulcerative colitis," Journal of Gastroenterology, 2002, vol. 37, Supple XIV, pp. 22-32.
Leonetti et al., "Increasing immunogenicity of antigens fused to Ig-binding proteins by cell surface targeting," The Journal of Immunology, 1998, vol. 160, pp. 3820-3827.
Magklara et al., "Characterization of the enzymatic activity of human kallikrein 6: autoactivation, substrate specificity and regulation by inhibitors," Biochem. Biophys. Res. Commun., Aug. 8, 2003, vol. 307, No. 4, pp. 948-955, Abstract Only.
Maxfield et al., "Conformation of poly(ethylene oxide) in the solid state, melt and solution measured by Raman scattering," Polymer, 1975, vol. 16, pp. 505-509.
Mine et al., "Structural mechanism for heparin-binding of the third Kunitz domain of human tissue factor pathway inhibitor," Biochemistry, 2002, vol. 41, pp. 78-85.
Molineux, "Pegylation: engineering improved pharmaceuticals for enhanced therapy," Cancer Treatment Reviews, 2002, vol. 28, pp. 13-16.

\* cited by examiner

```
5AOX1
---------------------------------->                                    BstB I
CG ACT TTT AAC GAC AAC TTG AGA AGA TCA AAA AAC AAC TAA TTA TTC GAA

ACG    ATG AGA TTC CCA TCT ATC TTC ACT GCT GTT TTG TTC GCT GCT
        M   R   F   P   S   I   F   T   A   V   L   F   A   A

TCC TCT GCT TTG GCT GCT CCA GTT AAC ACC ACT ACT GAA GAC GAG ACT
 S   S   A   L   A   A   P   V   N   T   T   T   E   D   E   T

GCT CAA ATT CCT GCT GAG GCT GTC ATC GGT TAC TCT GAC TTG GAA GGT
 A   Q   I   P   A   E   A   V   I   G   Y   S   D   L   E   G

GAC TTC GAC GTC GCT GTT TTG CCA TTC TCT AAC TCT ACT AAC AAC GGT
 D   F   D   V   A   V   L   P   F   S   N   S   T   N   N   G

TTG TTG TTC ATC AAC ACT ACC ATC GCT TCT ATC GCT GCT AAG GAG GAA
 L   L   F   I   N   T   T   I   A   S   I   A   A   K   E   E

GGT GTT TCC CTC GAG AAG AGA GAG GCT ATG CAC TCT TTC TGT GCT TTC
 G   V   S   L   E   K   R   E   A   M   H   S   F   C   A   F

AAG GCT GAC GAC GGT CCG TGC AGA GCT GCT CAC CCA AGA TGG TTC TTC
 K   A   D   D   G   P   C   R   A   A   H   P   R   W   F   F

AAC ATC TTC ACG CGT CAA TGC GAG GAG TTC ATC TAC GGT GGT TGT GAG
 N   I   F   T   R   Q   C   E   E   F   I   Y   G   G   C   E

GGT AAC CAA AAC AGA TTC GAG TCT CTA GAG GAG TGT AAG AAG ATG TGT
 G   N   Q   N   R   F   E   S   L   E   E   C   K   K   M   C
                          EcoR I
ACT AGA GAC TAG TAA GAA TTC GCC TTA GAC ATG ACT GTT CCT CAG TTC
 T   R   D   *   *                                      <--------
                                                           3'AOX1
AAG TTG GGC ACT TAC GAG AAG
------------------
       3'AOX1
```

FIGURE 1

```
SEQ ID 2:    (amino acids 3-60)  ----MHSFCAFKA-DDGPCRAAHPRWFFNIFTRQCEEFIYGG
SEQ ID 4:                        ----MHSFCAFKA-DDGPCKANHLRFFFNIFTRQCEEFSYGG
SEQ ID 5:                        ----MHSFCAFKA-DDGHCKANHQRFFFNIFTRQCEEFTYGG
SEQ ID 6:                        ----MHSFCAFKA-DDGHCKANHQRFFFNIFTRQCEQFTYGG
SEQ ID 7:                        ----MHSFCAFKA-DDGHCKASLPRFFFNIFTRQCEEFIYGG
SEQ ID 8:                        ----MHSFCAFKA-DDGHCKANHQRFFFNIFTRQCEEFSYGG
SEQ ID 9:                        ----MHSFCAKFA-DDGHCKGAHLRFFFNIFTRQCEEFIYGG
SEQ ID 10:                       ----MHSFCAFKA-DDGRCKGAHLRFFFNIFTRQCEEFIYGG
SEQ ID 11:                       ----MHSFCAFKA-DGGRCRGAHPRWFFNIFTRQCEEFSYGG
SEQ ID 12:                       ----MHSFCAFKA-DDGPCRAAHPRWFFNIFTRQCEEFSYGG
SEQ ID 13:                       ----MHSFCAFKA-DVGRCRGAHPRWFFNIFTRQCEEFSYGG
SEQ ID 14:                       ----MHSFCAFKA-DVGRCRGAQPRFFFNIFTRQCEEFSYGG
SEQ ID 15:                       ----MHSFCAFKA-DDGSCRAAHLRWFFNIFTRQCEEFSYGG
SEQ ID 16:                       ----MHSFCAFKA-EGGSCRAAHQRWFFNIFTRQCEEFSYGG
SEQ ID 17:                       ----MHSFCAFKA-DDGPCRGAHLRFFFNIFTRQCEEFSYGG
SEQ ID 18:                       ----MHSFCAFKA-DDGHCRGALPRWFFNIFTRQCEEFSYGG
SEQ ID 19:                       ----MHSFCAFKA-DSGNCRGNLPRFFFNIFTRQCEEFSYGG
SEQ ID 20:                       ----MHSFCAFKA-DSGRCRGNHQRFFFNIFTRQCEEFSYGG
SEQ ID 21:                       ----MHSFCAFKA-DGGRCRAIQPRWFFNIFTRQCEEFSYGG
SEQ ID 22:                       ----MHSFCAFKA-DDGRCRGAHPRWFFNIFTRQCEEFSYGG
BPTI    (SEQ ID 29):              ----RPDFCLEPP-YTGPCKARIIRYFYNAKAGLCQTFVYGG
ITI-D1  (SEQ ID 30):              ----KEDSCQLGY-SAGPCMGMTSRYFYNGTSMACETFQYGG
ITI-D2  (SEQ ID 31):              ----TVAACNLPI-VRGPCRAFIQLWAFDAVKGKCVLFPYGG
LACI-D1 (SEQ ID 32):              ----MHSFCAFKA-DDGPCKAIMKRFFFNIFTRQCEEFIYGG
LACI-D2 (SEQ ID 33):              ----KPDFCFLEE-DPGICRGYITRYFYNQTKQCERFKYGG
LACI-D3 (SEQ ID 34):              ----GPSWCLTPA-DRGLCRANENRFYYNSVIGKCRPFKYSG
HKI B9  (SEQ ID 35):              ----LPNVCAFPM-EKGPCQTYMTRWFFNFETGECELPAYGG
Cα3     (SEQ ID 36):              ----ETDICKLPK-DEGTCRDFILKWYYDPNTKSCARFWYGG
TFPI-2 D1 (SEQ ID 37):            ----NAEICLLPL-DYGPCRALLLRYYYDRYTQSCRQFLYGG
TFPI-2 D2 (SEQ ID 38):            ----VPKVCRLQVSVDDQCEGSTEKYFFNLSSMTCEKFFSGG
TFPI-2 D3 (SEQ ID 39):            ----IPSFCYSPK-DEGLCSANVTRYYFNPRYRTCDAFTYTG
APP-I   (SEQ ID 40):              ---RNREVCSEQA-ETGFCRAMISRWYFDVTEGKCAPFFYGG
EpiNE7  (SEQ ID 41):              ----RPDFCLEPP-YTGPCVAMFPRYFYNAKAGLCQTFVYGG
BITI-E7-141 (SEQ ID 42):          ----RPDFCQLGY-SAGPCVAMFPRYFYNGTSMACQTFVYGG
MUTT26A (SEQ ID 43):              ----RPDFCQLGY-SAGPCVAMFPRYFYNGASMACETFVYGG
MUTQE   (SEQ ID 44):              ----RPDFCQLGY-SAGPCVAMFPRYFYNGTSMACETFVYGG
MUT1619 (SEQ ID 45):              ----RPDFCQLGY-SAGPCVGMFSRYFYNGTSMACQTFVYGG
EPI-HNE-1 (SEQ ID 46):            EAEARPDFCLEPP-YTGPCIAFFPRYFYNAKAGLCQTFVYGG
EPI-HNE-2 (SEQ ID 47):            ------AACNLPI-VRGPCIAFFPRWAFDAVKGKCVLFPYGG
EPI-HNE-3 (SEQ ID 48):            ------AACNLPI-VRGPCIAFFPRWAFDAVKGKCVLFPYGG
EPI-HNE-4 (SEQ ID 49):            ------EACNLPI-VRGPCIAFFPRWAFDAVKGKCVLFPYGG
DPI14 KR (SEQ ID 50):             --EAVREVCSEQA-ETGPCIAFFPRWYFDVTEGKCAPFFYGG
DPI24 KR (SEQ ID 51):             --EANAEICLLPL-DYGPCIAFFPRYYDRYTQSCRQFLYGG
DPI68 KR (SEQ ID 52):             --EAKPDFCFLEE-DPGICIGFFPRYFYNNQAKQCERFVYGG
DPI84 KR (SEQ ID 53):             --EAETDICKLPK-DEGTCIAFFPRWYYDPNTKSCARFVYGG
```

FIGURE 2A

| | | |
|---|---|---|
| SEQ ID 2: | (cont.) | CEGNQ--NRFESLEECKKMCTRD |
| SEQ ID 4: | (cont.) | CGGNQ--NRFESLEECKKMCTRD |
| SEQ ID 5: | (cont.) | CGGNQ--NRFESLEECKKMCTRD |
| SEQ ID 6: | (cont.) | CAGNQ--NRFESLEECKKMCTRD |
| SEQ ID 7: | (cont.) | CGGNQ--NRFBSLEECKKMCTRD |
| SEQ ID 8: | (cont.) | CGGNQ--NRFESLEECKKMCTRD |
| SEQ ID 9: | (cont.) | CEGNQ--NRFESLEECKKMCTRD |
| SEQ ID 10: | (cont.) | CEGNQ--NRFESLEECKKMCTRD |
| SEQ ID 11: | (cont.) | CGGNQ--NRFESLEECKKMCTRD |
| SEQ ID 12: | (cont.) | CGGNQ--NRFESLEECKKMCTRD |
| SEQ ID 13: | (cont.) | CGGNQ--NRFESLEECKKMCTRD |
| SEQ ID 14: | (cont.) | CGGNQ--NRFESLEECKKMCTRD |
| SEQ ID 15: | (cont.) | CGGNQ--NRFESLEECKKMCTRD |
| SEQ ID 16: | (cont.) | CGGNQ--NRFESLEECKKMCTRD |
| SEQ ID 17: | (cont.) | CGGNQ--NRFESLEECKKMCTRD |
| SEQ ID 18: | (cont.) | CGGNQ--NRFESLEECKKMCTRD |
| SEQ ID 19: | (cont.) | CGGNQ--NRFESLEECKKMCTRD |
| SEQ ID 20: | (cont.) | CGGNQ--NRFESLEECKKMCTRD |
| SEQ ID 21: | (cont.) | CGGNQ--NRFESLEECKKMCTRD |
| SEQ ID 22: | (cont.) | CGGNQ--NRFESLEECKKMCTRD |
| BPTI (SEQ ID 29): | (cont.) | CRAKR--NNFKSAEDCMRTCGGA |
| ITI-D1 (SEQ ID 30): | (cont.) | CMGNG--NNFVTEKECLQTCRTV |
| ITI-D2 (SEQ ID 31): | (cont.) | CQGNG--NKFYSEKECREYCGVP |
| LACI-D1 (SEQ ID 32): | (cont.) | CEGNQ--NRFESLEECKKMCTRD |
| LACI-D2 (SEQ ID 33): | (cont.) | CLGNM--NNFETLEECKNICEDG |
| LACI-D3 (SEQ ID 34): | (cont.) | CGGNE--NNFTSKQECLRACKKG |
| HKI B9 (SEQ ID 35): | (cont.) | CGGNS--NNFLRKEKCEKFCKFT |
| Cα3 (SEQ ID 36): | (cont.) | CGGNE--NKFGSQKECEKVCAPV |
| TFPI-2 D1 (SEQ ID 37): | (cont.) | CEGNA--NNFYTWEACDDACWRI |
| TFPI-2 D2 (SEQ ID 38): | (cont.) | CHRNRIENRFPDEATCMGFCAPK |
| TFPI-2 D3 (SEQ ID 39): | (cont.) | CGGND--NNFVSREDCKRACAKA |
| APP-I (SEQ ID 40): | (cont.) | CGGNR--NNFDTEEYCMAVCGSA |
| EpiNE7 (SEQ ID 41): | (cont.) | CMGNG--NNFKSAEDCMRTCGGA |
| BITI-E7-141 (SEQ ID 42): | (cont.) | CMGNG--NNFVTEKDCLQTCRGA |
| MUTT26A (SEQ ID 43): | (cont.) | CMGNG--NNFVTEKDCLQTCRGA |
| MUTQE (SEQ ID 44): | (cont.) | CMGNG--NNFVTEKDCLQTCRGA |
| MUT1619 (SEQ ID 45): | (cont.) | CMGNG--NNFVTEKDCLQTCRGA |
| EPI-HNE-1 (SEQ ID 46): | (cont.) | CMGNG--NNFKSAEDCMRTCGGA |
| EPI-HNE-2 (SEQ ID 47): | (cont.) | CQGNG--NKFYSEKECREYCGVP |
| EPI-HNE-3 (SEQ ID 48): | (cont.) | CQGNG--NKFYSEKECREYCGVP |
| EPI-HNE-4 (SEQ ID 49): | (cont.) | CQGNG--NKFYSEKECREYCGVP |
| DPI14 KR (SEQ ID 50): | (cont.) | CGGNR--NNFDTEEYCMAVCGSA |
| DPI24 KR (SEQ ID 51): | (cont.) | CEGNA--NNFYTWEACDDACWRI |
| DPI68 KR (SEQ ID 52): | (cont.) | CLGNM--NNFETLEECKNICEDG |
| DPI84 KR (SEQ ID 53): | (cont.) | CGGNE--NKFGSQKECEKVCAPV |

FIGURE 2B

```
X63-G06        CAAGAGACATCCAGATGACCCAGTCTCCAGGCACCCTGTCTTTGTCTCCAGGGGAAAGAGCC
X81-B01        ---GAGATCGTGCTGACCCAGTCCCCTGCCACCCTGTCTCTGTCTCCCGGCGAGAGAGCC
**  ***        ** *********** *** ******  ** ******** ** ** **** ** ***** ***

X63-G06        ACCCTCTCCTGCAGGACCAGTCCTCAATTTGTTAACAGCAACTACTTAGCCTGGTACCAACAG
X81-B01        ACCCTGTCCTGCCGGGACCTCCCCAGTTCGTGAACTCCAACTACCTGGCTTGGTATCAGCAG
*****  ***** * **  *** ** **  **  * ******  **  ** ** *****  * *** ***

X63-G06        ACACCTGCCAGGCTCCCAGGCTCCTCATCTATGTGCATCAGCAGGGCCACTGGCATC
AAGCCAGGCCAGGCCCCTAGACTGCTGATCTACGGCGCCTCTTCCAGAGCCACCGGCATC
X81-B01        *  ** ** **** ** *   * ** **** *  *  * **  ** *  *** *  *****

X63-G06        CCAGACAGGTTCAGTGGCACTGGGTATGGGACAGACTTCACTCTCACCATCAGCAGACTG
X81-B01        CCTGACCGGTTCTCCGGCTCTCTGGCTCTGCTCCGGACTTCACCCTGACCATCTCCCGGCTG
*** *** *****  *** ** ***      ** **  **** *********  * ** * * ***

X63-G06        GAGCCTGAAGATTATGGAACTTACTACTGTCAGCAGAGTTCCAGAACCCCGTGGACGTTC
X81-B01        GAACCTGAGGACTTCGCCGTGTACTACTGCCAGCAGTCCTCCCGGACCCCTTGGACCTTT
**  ***** **  * *   ***  *******  ******  ** ** *  ****** * *  **

X63-G06        GGCCAAGGGACCAGAGTGGAAATCAAA
X81-B01        GGCCAGGGCACCAAGGTGGAGATCAAG
***** ** ****  ***** ******
```

FIGURE 3

```
X63-G06    QDIQMTQSPGTLSLSPGERATLSCRTSQFVNSNYLAWYQQTPGQAPRLLIYGASSRATGI
X81-B01    -EIVLTQSPGTLSLSPGERATLSCRTSQFVNSNYLAWYQQKPGQAPRLLIYGASSRATGI
             *********************************** ********************

X63-G06    PDRFSGTGYGTDFTLTISRLEPEDYGTYYCQQSRTPWTFGQGTRVEIK
X81-B01    PDRFSGSGSGTDFTLTISRLEPEDFAVYYCQQSRTPWTFGQGTKVEIK
           ******  * ************* * **************:****
```

FIGURE 4

```
X81-B01    GAGGTGCAATTGCTGGAATCCGGCGGAGGTCTGGTGCAGCCTGGCGGCTC
X63-G06    GAAGTTCAATTGTTAGAGTCTGGTGGCGGTCTTGTTCAGCCTGTGGTTC
           **  ** ****** ** * ***** ** **  *** ****** * * **

X81-B01    CCTGAGACTGTCTTGCGCGCCTCCGGCTTCACCTTCTCCCACTACCTGA
X63-G06    TTTACGTCTTTTCTGCGCTGTCTTCCGATTCACTTTCTCTCATTACCTTA
            *   * ***  ** ***  ** ** * ***** ***** ** **** *

X81-B01    TGACCTGGGTGCGCCAGGCTCCTGGCAAGGGCCTCGAATGGGTGTCCTAC
X63-G06    TGACTTGGGTTCGCCAAGCTCCTGGTAAAGGTTTGGAGTGGGTTTCTTAT
           ****  **** ** *** ******* ** **  ***  **** ** **

X81-B01    ATCTCCCCCTCTGGCGGCCACACCATCTACGCCGACTCCGTGAAGGGCCG
X63-G06    ATCTCCTTCTGGTGGCCATATTTATGCTGACTCCGTTAAAGGTCG
           ****** * * ** ** ** **  ** ** ********  ** ** **

X81-B01    GTTCACCATCTCCCGGGACAACTCCAAGAACACCCTGTATCTGCAGATGA
X63-G06    CTTCACTATCTCTAGAGACAACTCTAAGAATACTCTCTACTTGCAGATGA
            *****  ****  * *********  ****  ** *  * ********

X81-B01    ACTCCCTGAGGGCCGAGGACACCGCCGTGTACTACTGCGCCAGGGTGCC
X63-G06    ACAGCTTAAGGGCTGAGGACACGGCCGTGTATTACTGTGCGAGAGTGCC
           **    * ***** ******** ******** ***** ** * *****

X81-B01    AGAGGAATCGCCGCCAGGTCCCGGACCTCCTACTTCGACTACTGGGGCCA
X63-G06    CGGGGGATAGCAGCTCGATCGCGAACCAGCTACTTTGACTACTGGGGCCA
            * ** ** **  *  ** **  * ***  ***** *************

X81-B01    GGGCACCCTGGTGACCGTGTCCTCC
X63-G06    GGGAACCCTGGTCACCGTCTCAAGC
           *** ******** ***** **  *
```

FIGURE 5

```
X81-B01        EVQLLESGGGLVQPGGSLRLSCAASGFTFSHYLMTWVRQAPGKGLEWVSY
X63-G06        EVQLLESGGGLVQPGGSLRLSCAASGFTFSHYLMTWVRQAPGKGLEWVSY
               **************************************************

X81-B01        ISPSGGHTIYADSVKGRFTISRDNSKNTLYLQMNSLRAEDTAVYYCARVA
X63-G06        ISPSGGHTIYADSVKGRFTISRDNSKNTLYLQMNSLRAEDTAVYYCARVA
               **************************************************

X81-B01        RGIAARSRTSYFDYWGQGTLVTVSS
X63-G06        RGIAARSRTSYFDYWGQGTLVTVSS
               *************************
```

FIGURE 6

```
Human      ------------MILFKQATYFISLFATVSCGCLTQLYENAFFRGGDVASMYTPNAQYCQMRCT  52
Cow        ------------MIALRQAAYFICLFATVSCGCLTQLYHNIFFRGGDVSAMYTPDAQYCQLMCT  52
Mouse      ------------MILFNRVGYFVSLFATVSCGCMTQLYKNTFFRGGDLAAIYTPDAQYCQKMCT  52
Rat        ------------MILFKQVGYFVSLFATVSCGCLSQLYANFFFRGGDLAAIYTPDAQHCQKMCT  52
Pig        MEVIVLFRIISFRQAVYFMCLFAAVSCGCLPQLHKNYFFRGGDVSAMYTPSARHCQMMCT       60
Frog       ------------MACYYSSLLFLLLFTLVSGGCISELYQDIYWQGGDLRSVFAPDVEYCQLVCT  52
MACACA     ------------MILFKQATYFISLFATVSCGCLTQLYENAFFRGGDVASMYTPNAQHCQMMCT  52
Dog        ------------MLIKLP------LKWVSQGCLTQLYKNTFFKGGDLTAMYTPNAHHCQMMCT   45
                                                ::  **: :**  .: *:::*.**

Human      FHPRCLLFSFLPASSINDMEKRFGCFLKDSVTGTLPKVHRTGAVSGHSLKQCGHQISACH     112
Cow        FHPRCLLFSFLPENSTSDADKRFGCFLKDSVTGTLPRVSRTGAISGHSLKRCGHQISACH     112
Mouse      FHPRCLLFSFLAVTPPKETNKRFGCFMKESITGTLPRIHRTGAISGHSLKQCGHQISACH     112
Rat        FHPRCLLFSFLAVSPTKETDKRFGCFMKESITGTLPRIHRTGAISGHSLKQCGHQLSACH     112
Pig        FHPRCLLFSFLPADSTSVTDKRFGCFLKDSVTGMLPRVLRENAISGHSLKQCGHQIRACH     120
Frog       FSPRCLMFSYLPASWPK-ENERFACYIKESATNMLPKVTLTGVISGHSLKNCKSKINVCR    111
MACACA     FHPRCLLFSFLPASSINDMEKRFGCFLKDSVTGTLPKVRRAGAISGHSLKQCGHQISACH     112
Dog        FHPRCLLFSFLPESSTNDVNKRFGCFLKDSVTETLPRMSWTSAISGHSLKQCGHQISACH     105
           * *****.*:*  .      :**.*: :: *    . :* :   .:*. ** : : : .*:

Human      RDIYKGVDMRGVNFNVSKVSSVEECQKRCTNNIRCQFFSYATQTFHKAEYRNNCLLKYSP    172
Cow        RSIYKGIDMRGVNFNASKVRSAKECQERCTNNIHCQFFTYATKTFFSAEYRNTCLLKRSP    172
Mouse      RDIYKGLDMRGSNFNISKTDNIEECQKLCTNNFHCQFFTYATSAFYRPEYRKKCLLKHSA    172
Rat        QDIYEGLDMRGSNFNISKTDSIEECQKLCTNNIHCQFFTYATKAFHRPEYRKSCLLKRSS    172
Pig        RDIYKGIDMRGVNFNVSKVKTVEECQERCTNSIHCLFFTYATQAFNNAEYRNNCLLKHSP    180
Frog       DKNFPGIDMIGTNYNVTSTANVQQCKEGCTNDIYCQYFTYVTQEFHSAQLRNRCYFKYSG    171
MACACA     RDIYKGIDMRGVNFNVSKVSSVEECQKRCTNNIRCQFFSYATQTFHNAEYRNTCLLKHSP    172
Dog        RDIHKGIDMRGVNFNVSKVKSVEECQKKCTNSIHCQFFTYATETFYNVEYRNSCLLKNGP    165
            .  *:** . :*. *.    : *:.  **.* *  *: * .     :.  * :* .

Human      GGTPTAIKVLSNVESGFSLKPCALSEIGCHMNIFQHLAFSDVDVARVLTPDAFVCRTICT    232
Cow        QGTPTRIKVLSDVESGFSLKACGNSKIGCRVDIFQHSAFSDVDVAGIIAPDAFVCRTICT    232
Mouse      SGTPTSIKSADNLVSGFSLKSCALSEIGCPMDIFQHSAFADLNVSQVITPDAFVCRTICT    232
Rat        SGTPTSIKPVDNLVSGFSLKSCALSEIGCPMDIFQHFAFADLNVSQVVTPDAFVCRTICT    232
Pig        GGTPTSIKVLANVESGFSLKPCADSEIGCHMDIFQHLAFSDVDVARVIAPDAFVCRTVCT    240
Frog       KGMPTRIRLLDNVISGFSLKACGKSSLGCQNDLFQNMELPGETLTRVFAPDVLTCQKICT    231
MACACA     GGTPTTIKVLNNVESGFSLKPCALSEIGCHMNIFQHLAFSDVDVARVLAPDAFVCRTICT    232
Dog        GGTPSSIKVLADVVSGFSLKSCALSEIGCHMNIFQHLAFSDVDVARVVTPDAFVCQTICT    225
            * *: *:    : .*****.*.:  :**   :**.        . : ..:*.: *: **
```

FIGURE 9A

```
Human    YHPNCLFFTFYTNVWKIESQRNVCLLKTSESGTPSSSTPQE---NTISGYSLLTCKRTLP  289
Cow      YHPSCLFFTFYTNAWKTDSQRNVCFLKTSQSGSPSSPTPQE---NAISGYSLLTCKQTLP  289
Mouse    FHPNCLFFTFYTNEWETESQRNVCFLKTSKSGRPSPPIPQE---NAISGYSLLTCRKTRP  289
Rat      FHPNCLFFTFYTNEWETESQRNVCFLKTSKSGRPSPPIIQE---NAVSGYSLFTCRKARP  289
Pig      YHPNCLFFTFYTNAWKIESQRNVCFLKTSHSGTPSFPTPQE---NAISGYSLLTCKQTLP  297
Frog     FYPNCLFFTFFKKDSKDPLQRNVCYVRTSTKGIPDEVINKE---HTISGFSLLSCKFSPS  288
MACACA   YHPSCLFFTFYTNAWKIESQRRVCMLAGSQDGAAHSSLGDARLRLQKNKNKQTKKNTLP  292
Dog      YHPNCLFFTFYTKAWHLEPQRNVCFLKTSKSGTPSSPTSQK---NAMSGYSLLTCKKALP  282
         :*:.*******:: .  *:  ***: ** .*:  *.   .   :  *:*.:  * *

Human    --EPCHSKIYPGVDFGEEELNVTFVKGVNVCQETCTKMIRCQFFTYSLLPEDCKEEKCKC  347
Cow      GTEPCHSKIYPQVAFEGEELHVTFVKGVDGCQETCTKMIRCQFFTYSLFPEDCRGEKCKC  349
Mouse    --EPCHSKIYSGVDFEGEELNVTFVQGADVCQETCTKTIRCQFFIYSLLPQDCKEEGCKC  347
Rat      --EPCHFKIYSGVAFEGEELNATFVQGADACQETCTKTIRCQFFTYSLLPQDCKAEGCKC  347
Pig      --EPCHSKIYSEVDFEGEELNVTFVQGANLCQETCTKTIRCQFFTYSLHPEDCRGEKCKC  355
Frog     ---VCPLTMLSDSEFLGDELLVEEVSGEKECQQACTNNIRCQFFTYGPVKSGCLEKKCKC  345
MACACA   --EPCHSKIYPGVDFGEEELNVTFVKGVNVCQETCTKMIRCQFFTYSLLPEDCKEEKCKC  350
Dog      --EPCHSKIYSGVDFEGEELNVTFAEGVNACQETCTKMIRCQFFTYSLRPEDCRGEKCKC  340
             *      . :*  *:** .**. * :  *  * :.****  * :. .*  *. **

|Start Catalytic Domain
Human    FLRLSMDGSPTRIAYGTQGSSGYSLRLCNTGDNSVCT---TKTSTRIVGGTNSSWGEWPWQ  405
Cow      SLRLSLDGSPTNITYGTQASSGYSLRLCKRGDSRVCT---TKR-TRIVGGTNASWGEWPWQ  406
Mouse    SLRLSTDGSPTRITYGMQGSSGYSLRLCKLVDSPDCT---TKINARIVGGTNASLGEWPWQ  405
Rat      SLRLSTDGSPTRITYEAQGSSGYSLRLCKVVESSDCT---TKINARIVGGTNSSLGEWPWQ  405
Pig      SLRLSSDGSPTKITHGMRASSGYSLRLCRSGDHSACA---TKANTRIVGGTDSFLGEWPWQ  413
Frog     HMKISSNGLPTGIRHGNGIGSFSLRLCKMKSVKGCGEPSEHANRIVGGTDSVLGEWPWQ  405
MACACA   FLRLSSDGSPTRITYGTQGSSGYSLRLCNTGDSSVCT---TKTSSRIVGGTNSSWGEWPWQ  408
Dog      SLRLSLDGSPTGMTYGTRVSSGYSLRLCKSGDSSVCT---TKTSTRIVGGTNSSWGEWPWQ  398
          :. . .. *. *  *  . * *****.      .       :  :****..:  *****

@@@@@@@@@@@@@          #@@@@@@@@@@@
                             ++++++++++++++++++(C1)                     ++
Human    VSLQVKLTA--QRHLCGGSLIGHQWVLTAAHCFPDGLPLQDVWRIYSGILNLSDITKDTPF  463
Cow      VSLQVKQRA--QSHLCGGSIIGRQWVLTAAHCFDGLLLSNIWRIYGGILNLSEITTETSF  464
Mouse    VSLQVKLVS--QTHLCGGSIIGRQWVLTAAHCFDGIPYPDVWRIYGGILSLSEITKETPS  463
Rat      VSLQVKLVS--QNHMCGGSIIGRQWILTAAHCFDGIPYPDVWRIYGGILNLSEITNKTPF  463
Pig      VSLQAKLRA--QNHLCGGSIIGHQWVLTAAHCFDGLSLPDIWRIYGGILNISEITKETPF  471
Frog     VSMHLRLGASYKKHACGGSIISNQWIVTAAHCVALYPQPQMWIIYSGFVRILNLSDITKSTPF  465
MACACA   VSLQVKLMA--QRHLCGGSLIGHQWVLTAAHCFDGLPLPDVWRIYSGILNLSDITKETPF  466
Dog      VSLQVKLRA--QSHLCGGSIIGRQWVLTAAHCFDELSLPDVWRIYSGILNLSEITKETPF  456
         **:  :     : : ****:*. **::****.       ::  *:::: *::     *

```
                       @@@@@@@@@@@
               ++++++++++(C2)     +++++++(C3)                                 +++++
Human    SQIKEIIIHQNYKVSEG-NHDIALIKLQAPLNYTEFQKPICLPSKGDTSTIYTNCWVTGW 522
Cow      SQIKEIIVHPNYKISEG-SHDIALIKLEAPLNFTDLQKAICLPSKDDTKPVYTDCWITGW 523
Mouse    SRIKELIIHQEYKVSEG-NYDIALIKLQTPLNYTEFQKPICLPSKADTNTIYTNCWVTGW 522
Rat      SSIKELIIHQKYKMSEG-SYDIALIKLQTPLNYTEFQKPICLPSKADTNTIYTNCWVTGW 522
Pig      SQVKEIIIHQNYKILES-GHDIALLKLETPLNYTDFQKPICLPSRDDTNVVYTNCWVTGW 530
Frog     SELEKIIIHPHYTGAGN-GSDIALLKLKTPIVFNDHQKAICLPPSEATLVLPNSCWITGW 524
MACACA   SQIKEIIIHQNVRISEG-NHDIALIKLQAPLNYTEFQKPICLPSKGDTNTIYTNCWVTGW 525
Dog      SQIKEIIIHQNYKITDGGSYDIALIKLEAPLNYTEFQKPICLPSKDDTNTTYTNCWVTGW 516
         *  :::::*.  *                 .  *******:*:   .: .*****   .  ..*:;***

@@@@@@@@@@              @@@@@@@@@@
              ++++++++++(C4)          ++++++++++++++(C5)           +++++++++++(C6)
Human    GESKEKGEIQNLQKVNIPLVTNEECQKRYQDYKITQQMVCAGYKEGGKDACKGDSGGPL 582
Cow      GFTEEKGKIQNLQKANIPLISNEECQKSYRDYKITKQMICAGYKEGGKDACKGDSGGPL 583
Mouse    GYTKEQGETQNILQKATIPLVPNEECQKKYRDYVINKQMICAGYKEGGTDACKGDSGGPL 582
Rat      GYTKERGETQNILQKATIPLVPNEECQKKYRDYVITKQMICAGYKEGGIDACKGDSGGPL 582
Pig      GFTEEKGEIQNILQKVNIPLVSNEECQKSYRDHKISKQMICAGYKEGGKDACKESGGPL 590
Frog     GYTEETGSPGNVLQKAEVPPISTEECQGSYVETRIDKKVLCAGYKSGKIDACKGDSGGPL 584
MACACA   GFSKEKGEIQDILQKVNIPLVTNEECQKRYQDYKITQRMVCAGYKEGGKDACKGDSGGPL 585
Dog      GFTKERGEIQNSLQKANIPLVNEECQKKYRDYEVNKQMICAGYKEGGKDACKGDSGGPL 576
         *:::* *.  :   ** :.****  :     :     :   *****..* *****.******

@@@@@@@@@@@
              ++++(C7)
Human    VCKHNGMWRLVGITSWGEGCARREQPGVYTKVAEYMDWILEKTQSDGKAQMQSPA 638
Cow      VCQHEETWHLVGITSWGEGCARREQPGVYTKVAEYVDWILEKTQDSHGQPLRK--- 636
Mouse    VCKHSGRWQLVGITSWGEGCGRKDQPGVYTKVSEYMDWILEKTQSSDVRALETSSA 638
Rat      VCKHSGRWQLVGITSWGEGCAREQPGVYTKVAEYIDWILEKIQSKERALETSPA 638
Pig      VCKYNGIWHLVGTTSWGEGCARREQPGVYTKVIEYMDWILEKTQDDGQSWMK---- 643
Frog     VCEVDEIWYLTGITSWGEGCARPGKPGVYTRVSTFTNWILEHTKL---------- 629
MACACA   ACKHNGMWRLVGITSWGEGCARREQPGVYTKVAEYMDWILEKTQSSDGNARMQAPA 641
Dog      VCKHNGNWHLVGITSWGEGCGREQPGVYTKVAEYVDWILEKTQVDGHAGLG---- 629
         .*:  .  *.*.* ********.*   ::*****:* :    **:**:  ::
```

FIGURE 9C

NOTE: The underlined positions are the amino acids that form the catalytic triad (His434, Asp483, and Ser578, numbering based on the human sequence).

TREATMENT OF MUCOSITIS WITH KALLIKREIN INHIBITORS

CROSS REFERENCE TO RELATED APPLICATIONS

This application claims priority to U.S. Application Ser. No. 61/142,746, filed on Jan. 6, 2009. The disclosure of the prior application is considered part of (and is incorporated by reference in) the disclosure of this application.

BACKGROUND

Mucositis is a common serious side effect of high-dose chemotherapy (CT) and/or radiotherapy (RT) regimens often manifested as erythema and painful ulcerative lesions of the mouth, esophagus, pharynx and gastrointestinal tract that threatens the successful treatment of at least 600,000 people worldwide. These cytoreductive therapies aimed at killing cancer cells can also indiscriminately destroy other fast-growing cells such as the lining of the mouth and throat and gastrointestinal tract.

The development of mucositis is a complex process. Typically, mucositis symptoms develop 5 to 8 days following the administration of CT and last approximately 7 to 14 days. The pathobiology of mucositis is currently defined as a 5-phase process: initiation, signaling with generation of messengers, amplification, ulceration, and, finally, healing.

Oral and gastrointestinal (GI) mucositis can affect up to 100% of patients undergoing high-dose chemotherapy and hematopoietic stem cell transplantation (HSCT), 80% of patients with malignancies of the head and neck receiving radiotherapy, and a wide range of patients receiving chemotherapy. For most cancer treatments, about 5-15% of patients get mucositis. However, with 5-fluorouracil (5-FU), up to 40% get mucositis, and 10-15% get grade 3-4 oral mucositis. Irinotecan treatment is associated with severe GI mucositis in over 20% of patients. 75-85% of bone marrow transplantation recipients experience mucositis, of which oral mucositis is the most common and most debilitating, especially when melphalan is used. In grade 3 oral mucositis, the patient is unable to eat solid food, and in grade 4, the patient is unable to consume liquids either. Radiotherapy to the head and neck or to the pelvis or abdomen is associated with grade 3 and grade 4 oral or GI mucositis, respectively, often exceeding 50% of patients. Among patients undergoing head and neck radiotherapy, pain and decreased oral function may persist long after the conclusion of therapy. Fractionated radiation dosage increases the risk of mucositis to >70% of patients in most trials.

Oral mucositis has been identified as the most debilitating side effect of anticancer therapy by patients who experienced it while undergoing myelotoxic therapy for hematopoietic stem cell transplant, which is associated with the greatest degree of mucosal toxicity with 70%-80% of patients suffering from oral mucositis. Consequent morbidities of severe oral mucositis can include pain severe enough to require opioid analgesia, difficulty or inability to swallow due to ulcerations in the mouth and throat, which, if severe, may necessitate total parenteral nutrition (TPN) and rehydration, difficulty or inability to talk, which can hinder patients' abilities to communicate. Of significance, the development of oral mucositis often precludes oncologists from prescribing a full dose and regimen of chemotherapy or radiation therapy so that the disease frequently limits the potential full benefit of possibly curative treatments. The burden of oral mucositis development has been estimated to add $4,000 to hospital costs for patients with head and neck cancers to $43,000 for undergoing patients bone marrow transplant.

Managing oral mucositis is primarily supportive. There are many different methods to help relieve the pain, including sucking on ice cubes, antioxidants, and mouth rinses. Several mouth rinses are available that combine antihistamines, anesthetics, anti-inflammatory medications (such as corticosteroids), antibiotics, and antifungals. Narcotic analgesics may also prove to help relieve the pain. Other methods include antimicrobials, anti-inflammatories, and good oral care.

Palifermin (KEPIVANCE®) (human keratinocyte growth factor (KGF)) is the only drug approved for oral mucositis and is indicated to decrease the incidence and duration of severe oral mucositis in patients with hematologic malignancies receiving myelotoxic therapy requiring hematopoietic stem cell support/transplantation. However, HSCT represents a small subset of the cancer population and most solid tumors carry KGF receptors, through which this agent might have potentially undesired agonist effect. Thus, application of palifermin (KEPIVANCE®) to the larger market of cancers and consequent oral mucositis resulting from treatment thereof is extremely unlikely. Additional indication studies beyond HSCT are currently being done, and include use of the drug in graft versus host disease, head and neck cancers, Stage 2/3 colon cancer multiple myeloma, lymphoma and leukemia, and pediatric HSCT populations.

Thus, there remains a significant unmet need in the treatment of mucositis.

SUMMARY

Disclosed herein are methods for the treatment of mucositis, in particular oral mucositis. In one aspect, the invention provides methods for the treatment of mucositis comprising administration of a therapeutically effective amount of an isolated inhibitor of kallikrein, optionally in combination with another agent, such as palifermin (KEPIVANCE®) (human keratinocyte growth factor (KGF)). The methods described herein include administering an effective amount of the kallikrein inhibitor. Such an amount can be an amount sufficient to produce a detectable improvement, to reduce or ameliorate at least one symptom, to modulate (e.g., improve) at least one physiological parameter, or to prevent the development of more severe grades of the illness to a statistically significant degree.

Disclosed herein are methods for preventing mucositis, in particular oral mucositis. In one aspect, the invention provides methods for the prevention of mucositis (e.g., in a subject at risk of developing mucositis) comprising administration of a prophylactically effective amount of an isolated inhibitor of kallikrein, optionally in combination with another agent, such as palifermin (KEPIVANCE®) (human keratinocyte growth factor (KGF)). The methods described herein include administering an effective amount of the kallikrein inhibitor. Such an amount can be an amount sufficient to reduce or delay or ameliorate at least one symptom or one physiological parameter. A subject (e.g., patient) who is at risk for developing mucositis can be, e.g., a subject who will be undergoing, is undergoing, or will be undergoing a chemotherapy (e.g., high-dose chemotherapy) and/or radiotherapy regimen. As another example, a subject (e.g., patient) who is at risk for developing mucositis can be, e.g., a subject who has been diagnosed with cancer, e.g., cancer of the head or neck.

The kallikrein inhibitor useful in the methods, compositions and kits may be, e.g., a plasma kallikrein (pKal) or tissue kallikrein inhibitor. In some embodiments, the inhibitor is a plasma kallikrein inhibitor.

The kallikrein inhibitors useful in the methods, compositions and kits may be any of the Kunitz domain polypeptides described herein, larger polypeptides comprising any such Kunitz domains, provided the kallikrein inhibitor polypeptides bind and inhibit kallikrein as determined in standard assays, kallikrein binding proteins (e.g., antibodies, e.g., anti-plasma kallikrein antibodies), or other kallikrein inhibitors described herein.

In some embodiments, the kallikrein inhibitor comprises or consists of the amino acid sequence Glu Ala Met His Ser Phe Cys Ala Phe Lys Ala Asp Asp Gly Pro Cys Arg Ala Ala His Pro Arg Trp Phe Phe Asn Ile Phe Thr Arg Gln Cys Glu Glu Phe Ile Tyr Gly Gly Cys Glu Gly Asn Gln Asn Arg Phe Glu Ser Leu Glu Glu Cys Lys Lys Met Cys Thr Arg Asp (SEQ ID NO:2), or a fragment thereof, such as amino acids 3-60 of SEQ ID NO:2.

In some embodiments, the kallikrein inhibitor comprises or consists of the amino acid sequence Met His Ser Phe Cys Ala Phe Lys Ala Asp Asp Gly Pro Cys Arg Ala Ala His Pro Arg Trp Phe Phe Asn Ile Phe Thr Arg Gln Cys Glu Glu Phe Ile Tyr Gly Gly Cys Glu Gly Asn Gln Asn Arg Phe Glu Ser Leu Glu Glu Cys Lys Lys Met Cys Thr Arg Asp (amino acids 3-60 of SEQ ID NO:2).

In some embodiments, the kallikrein inhibitor comprises a plasma kallikrein binding protein (e.g., antibody, e.g., an anti-plasma kallikrein antibody described herein).

In some embodiments, the binding protein (e.g., antibody, e.g., human antibody) binds the same epitope or competes for binding with a protein described herein.

In some embodiments, the protein described herein is selected from the group consisting of M162-A04, M160-G12, M142-H08, X63-G06, X81-B01, X67-D03, and X67-G04.

In some embodiments, the plasma kallikrein binding protein competes with or binds the same epitope as X81-B01.

In some embodiments, the plasma kallikrein binding protein competes with or binds the same epitope as X67-D03.

In some embodiments, the plasma kallikrein binding protein does not bind prekallikrein (e.g., human prekallikrein), but binds to the active form of plasma kallikrein (e.g., human plasma kallikrein).

In certain embodiments, the protein binds at or near the active site of the catalytic domain of plasma kallikrein, or a fragment thereof, or binds an epitope that overlaps with the active site of plasma kallikrein.

In some embodiments, the protein binds to one or more amino acids that form the catalytic triad of plasma kallikrein: His434, Asp483, and/or Ser578 (numbering based on the human sequence).

In some embodiments, the protein binds to one or more amino acids of Ser479, Tyr563, and/or Asp585 (numbering based on the human sequence).

In some embodiments, the plasma kallikrein binding protein decreases Factor XIIa and/or bradykinin production by greater than about 5%, about 10%, about 15%, about 20%, about 25%, about 30%, about 35%, about 40%, about 45%, about 50%, about 55%, about 60%, about 65%, about 70%, about 75%, about 80%, about 85%, about 90%, or about 95% as compared to a standard, e.g., the Factor XIIa and/or bradykinin production under the same conditions but in the absence of the protein.

In some embodiments, the plasma kallikrein binding protein has an apparent inhibition constant ($K_{i,app}$) of less than 1000, 500, 100, or 10 nM.

In one embodiment, the HC and LC variable domain sequences are components of the same polypeptide chain.

In another embodiment, the HC and LC variable domain sequences are components of different polypeptide chains. For example, the plasma kallikrein binding protein is an IgG., e.g., IgG1, IgG2, IgG3, or IgG4. The plasma kallikrein binding protein can be a soluble Fab (sFab).

In other implementations the plasma kallikrein binding protein includes a Fab2', scFv, minibody, scFv::Fc fusion, Fab::HSA fusion, HSA::Fab fusion, Fab::HSA::Fab fusion, or other molecule that comprises the antigen combining site of one of the binding proteins herein. The VH and VL regions of these Fabs can be provided as IgG, Fab, Fab2, Fab2', scFv, PEGylated Fab, PEGylated scFv, PEGylated Fab2, VH::CH1::HSA+LC, HSA::VH::CH1+LC, LC::HSA+VH::CH1, HSA::LC+VH::CH1, or other appropriate construction.

In one embodiment, the plasma kallikrein binding protein is a human or humanized antibody or is non-immunogenic in a human. For example, the protein includes one or more human antibody framework regions, e.g., all human framework regions.

In one embodiment, the plasma kallikrein binding protein includes a human Fc domain, or an Fc domain that is at least 95, 96, 97, 98, or 99% identical to a human Fc domain.

In one embodiment, the plasma kallikrein binding protein is a primate or primatized antibody or is non-immunogenic in a human. For example, the protein includes one or more primate antibody framework regions, e.g., all primate framework regions.

In one embodiment, the plasma kallikrein binding protein includes a primate Fc domain, or an Fc domain that is at least 95, 96, 97, 98, or 99% identical to a primate Fc domain. "Primate" includes humans (*Homo sapiens*), chimpanzees (*Pan troglodytes* and *Pan paniscus* (bonobos)), gorillas (*Gorilla gorilla*), gibbons, monkeys, lemurs, aye-ayes (*Daubentonia madagascariensis*), and tarsiers.

In one embodiment, the plasma kallikrein binding protein includes human framework regions, or framework regions that are at least 95, 96, 97, 98, or 99% identical to human framework regions.

In certain embodiments, the plasma kallikrein binding protein includes no sequences from mice or rabbits (e.g., is not a murine or rabbit antibody).

In some embodiments, the mucositis is selected from the group consisting of oral, esophageal, pharyngeal and gastrointestinal mucositis.

In some embodiments, the mucositis is oral mucositis.

In some embodiments, the method further comprises administering palifermin.

In some embodiments, the binding protein (e.g., antibody, e.g., human antibody) comprises a heavy chain immunoglobulin variable domain sequence and a light chain immunoglobulin variable domain sequence, wherein:

the heavy chain immunoglobulin variable domain sequence comprises one, two, or three (e.g., three) CDR regions from the heavy chain variable domain of a protein described herein, and/or the light chain immunoglobulin variable domain sequence comprises one, two, or three (e.g., three) CDR regions from the light chain variable domain of a protein described herein, wherein the protein binds to (e.g., and inhibits) plasma kallikrein.

In some embodiments, the heavy chain immunoglobulin variable domain sequence comprises one, two, or three (e.g., three) CDR regions from the heavy chain variable domain of M162-A04, M160-G12, M142-H08, X63-G06, X81-B01, X67-D03, or X67-G04, and/or the light chain immunoglobulin variable domain sequence comprises one, two, or three (e.g., three) CDR regions from the light chain variable domain of M162-A04, M160-G12, M142-H08, X63-G06, X81-B01, X67-D03, or X67-G04 (respectively).

In some embodiments, the one, two, or three (e.g., three) CDR regions from the heavy chain variable domain are from X81-B01 and/or the one, two, or three (e.g., three) CDR regions from the light chain variable domain are from X81-B01.

In some embodiments, the one, two, or three (e.g., three) CDR regions from the heavy chain variable domain are from X67-D03 and/or the one, two, or three (e.g., three) CDR regions from the light chain variable domain are from X67-D03.

In some embodiments, the heavy chain immunoglobulin variable domain sequence comprises the heavy chain variable domain of a protein described herein, and/or the light chain immunoglobulin variable domain sequence comprises the light chain variable domain of a protein described herein.

In some embodiments, the heavy chain immunoglobulin variable domain sequence comprises the heavy chain variable domain of M162-A04, M160-G12, M142-H08, X63-G06, X81-B01, X67-D03, or X67-G04, and/or the light chain immunoglobulin variable domain sequence comprises the light chain variable domain of M162-A04, M160-G12, M142-H08, X63-G06, X81-B01, X67-D03, or X67-G04 (respectively).

In some embodiments, the heavy chain immunoglobulin variable domain sequence comprises the heavy chain variable domain of X81-B01, and/or the light chain immunoglobulin variable domain sequence comprises the light chain variable domain of X81-B01.

In some embodiments, the heavy chain immunoglobulin variable domain sequence comprises the heavy chain variable domain of X67-D03, and/or the light chain immunoglobulin variable domain sequence comprises the light chain variable domain of X67-D03.

In some embodiments, the protein comprises the heavy chain of a protein described herein, and/or the light chain of a protein described herein.

In some embodiments, the protein comprises the heavy chain of M162-A04, M160-G12, M142-H08, X63-G06, X81-B01, X67-D03, or X67-G04, and/or the light chain of M162-A04, M160-G12, M142-H08, X63-G06, X81-B01, X67-D03, or X67-G04 (respectively).

In some embodiments, the protein comprises the heavy chain of X81-B01, and/or the light chain of X81-B01.

In some embodiments, the protein comprises the heavy chain of X67-D03, and/or the light chain of X67-D03.

In some embodiments, the protein includes one or more of the following characteristics: (a) a human CDR or human framework region; (b) the HC immunoglobulin variable domain sequence comprises one or more (e.g., 1, 2, or 3) CDRs that are at least 85, 88, 89, 90, 91, 92, 93, 94, 95, 96, 97, 98, 99, or 100% identical to a CDR of a HC variable domain described herein; (c) the LC immunoglobulin variable domain sequence comprises one or more (e.g., 1, 2, or 3) CDRs that are at least 85, 88, 89, 90, 91, 92, 93, 94, 95, 96, 97, 98, 99, or 100% identical to a CDR of a LC variable domain described herein; (d) the LC immunoglobulin variable domain sequence is at least 85, 88, 89, 90, 91, 92, 93, 94, 95, 96, 97, 98, 99, or 100% identical to a LC variable domain described herein (e.g., overall or in framework regions or CDRs); (e) the HC immunoglobulin variable domain sequence is at least 85, 88, 89, 90, 91, 92, 93, 94, 95, 96, 97, 98, 99, or 100% identical to a HC variable domain described herein (e.g., overall or in framework regions or CDRs); (f) the protein binds an epitope bound by a protein described herein, or competes for binding with a protein described herein; (g) a primate CDR or primate framework region; (h) the HC immunoglobulin variable domain sequence comprises a CDR1 that differs by at least one amino acid but by no more than 2 or 3 amino acids from the CDR1 of a HC variable domain described herein; (i) the HC immunoglobulin variable domain sequence comprises a CDR2 that differs by at least one amino acid but by no more than 2, 3, 4, 5, 6, 7, or 8 amino acids from the CDR2 of a HC variable domain described herein; (j) the HC immunoglobulin variable domain sequence comprises a CDR3 that differs by at least one amino acid but by no more than 2, 3, 4, 5, or 6 amino acids from the CDR3 of a HC variable domain described herein; (k) the LC immunoglobulin variable domain sequence comprises a CDR1 that differs by at least one amino acid but by no more than 2, 3, 4, or 5 amino acids from the CDR1 of a LC variable domain described herein; (l) the LC immunoglobulin variable domain sequence comprises a CDR2 that differs by at least one amino acid but by no more than 2, 3, or 4 amino acids from the CDR2 of a LC variable domain described herein; (m) the LC immunoglobulin variable domain sequence comprises a CDR3 that differs by at least one amino acid but by no more than 2, 3, 4, or 5 amino acids from the CDR3 of a LC variable domain described herein; (n) the LC immunoglobulin variable domain sequence differs by at least one amino acid but by no more than 2, 3, 4, 5, 6, 7, 8, 9, or 10 amino acids from a LC variable domain described herein (e.g., overall or in framework regions or CDRs); and (o) the HC immunoglobulin variable domain sequence differs by at least one amino acid but by no more than 2, 3, 4, 5, 6, 7, 8, 9, or 10 amino acids from a HC variable domain described herein (e.g., overall or in framework regions or CDRs).

In some embodiments, the protein has an apparent inhibition constant ($K_{i,app}$) of less than 1000, 500, 100, or 10 nM.

In a preferred embodiment, the protein is an antibody (e.g., a human antibody) having the light and heavy chains of antibodies selected from the group consisting of M162-A04, M160-G12, M142-H08, X63-G06, X81-B01, X67-D03, and X67-G04.

In a preferred embodiment, the protein is an antibody (e.g., a human antibody) having the heavy chain of an antibody selected from the group consisting of: M162-A04, M160-G12, M142-H08, X63-G06, X81-B01, X67-D03, and X67-G04.

In a preferred embodiment, the protein is an antibody (e.g., a human antibody) having the light chain of an antibody selected from the group consisting of: M162-A04, M160-G12, M142-H08, X63-G06, X81-B01, X67-D03, and X67-G04.

In a preferred embodiment, the protein is an antibody (e.g., a human antibody) having light and heavy antibody variable regions of an antibody selected from the group consisting of M162-A04, M160-G12, M142-H08, X63-G06, X81-B01, X67-D03, and X67-G04.

In a preferred embodiment, the protein is an antibody (e.g., a human antibody) having a heavy chain antibody variable region of an antibody selected from the group consisting of: M162-A04, M160-G12, M142-H08, X63-G06, X81-B01, X67-D03, and X67-G04.

In a preferred embodiment, the protein is an antibody (e.g., a human antibody) having a light chain antibody variable region of an antibody selected from the group consisting of: M162-A04, M160-G12, M142-H08, X63-G06, X81-B01, X67-D03, and X67-G04.

In a preferred embodiment, the protein is an antibody (e.g., a human antibody) having one or more (e.g., 1, 2, or 3) heavy chain CDRs selected from the corresponding CDRs of the group of heavy chains consisting of M162-A04, M160-G12, M142-H08, X63-G06, X81-B01, X67-D03, and X67-G04.

In a preferred embodiment, the protein is an antibody (e.g., a human antibody) having one or more (e.g., 1, 2, or 3) light chain CDRs selected from the corresponding CDRs of the group of light chains consisting of M162-A04, M160-G12, M142-H08, X63-G06, X81-B01, X67-D03, and X67-G04.

In a preferred embodiment, the protein is an antibody (e.g., a human antibody) having one or more (e.g., 1, 2, or 3) heavy chain CDRs selected from the corresponding CDRs of the group of heavy chains consisting of M162-A04, M160-G12, M142-H08, X63-G06, X81-B01, X67-D03, and X67-G04 and one or more (e.g., 1, 2, or 3) light chain CDRs selected from the corresponding CDRs of the group of light chains consisting of M162-A04, M160-G12, M142-H08, X63-G06, X81-B01, X67-D03, and X67-G04 (respectively).

In a preferred embodiment, the protein is an antibody (e.g., a human antibody) having the light and heavy chains of X81-B01.

In a preferred embodiment, the protein is an antibody (e.g., a human antibody) having the heavy chain of X81-B01.

In a preferred embodiment, the protein is an antibody (e.g., a human antibody) having the light chain of X81-B01.

In a preferred embodiment, the protein is an antibody (e.g., a human antibody) having light and heavy antibody variable regions of an antibody selected from X81-B01.

In a preferred embodiment, the protein is an antibody (e.g., a human antibody) having a heavy chain antibody variable region of X81-B01.

In a preferred embodiment, the protein is an antibody (e.g., a human antibody) having a light chain antibody variable region of X81-B01.

In a preferred embodiment, the protein is an antibody (e.g., a human antibody) having one or more (e.g., 1, 2, or 3) heavy chain CDRs from the corresponding CDRs of the heavy chain of X81-B01.

In a preferred embodiment, the protein is an antibody (e.g., a human antibody) having one or more (e.g., 1, 2, or 3) light chain CDRs from the corresponding CDRs of the light chain of X81-B01.

In a preferred embodiment, the protein is an antibody (e.g., a human antibody) having one or more (e.g., 1, 2, or 3) heavy chain CDRs from the heavy chain of X81-B01 and one or more (e.g., 1, 2, or 3) light chain CDRs from the corresponding CDRs of the light chain of X81-B01.

In a preferred embodiment, the protein is an antibody (e.g., a human antibody) having the light and heavy chains of X67-D03.

In a preferred embodiment, the protein is an antibody (e.g., a human antibody) having the heavy chain of X67-D03.

In a preferred embodiment, the protein is an antibody (e.g., a human antibody) having the light chain of X67-D03.

In a preferred embodiment, the protein is an antibody (e.g., a human antibody) having light and heavy antibody variable regions of an antibody selected from X67-D03.

In a preferred embodiment, the protein is an antibody (e.g., a human antibody) having a heavy chain antibody variable region of X67-D03.

In a preferred embodiment, the protein is an antibody (e.g., a human antibody) having a light chain antibody variable region of X67-D03.

In a preferred embodiment, the protein is an antibody (e.g., a human antibody) having one or more (e.g., 1, 2, or 3) heavy chain CDRs from the corresponding CDRs of the heavy chain of X67-D03.

In a preferred embodiment, the protein is an antibody (e.g., a human antibody) having one or more (e.g., 1, 2, or 3) light chain CDRs from the corresponding CDRs of the light chain of X67-D03.

In a preferred embodiment, the protein is an antibody (e.g., a human antibody) having one or more (e.g., 1, 2, or 3) heavy chain CDRs from the heavy chain of X67-D03 and one or more (e.g., 1, 2, or 3) light chain CDRs from the corresponding CDRs of the light chain of X67-D03.

In some embodiments, the plasma kallikrein binding protein does not bind prekallikrein (e.g., human prekallikrein), but binds to the active form of plasma kallikrein (e.g., human plasma kallikrein).

In some embodiments, the plasma kallikrein binding protein decreases Factor XIIa and/or bradykinin production by greater than about 5%, about 10%, about 15%, about 20%, about 25%, about 30%, about 35%, about 40%, about 45%, about 50%, about 55%, about 60%, about 65%, about 70%, about 75%, about 80%, about 85%, about 90%, or about 95% as compared to a standard, e.g., the Factor XIIa and/or bradykinin production under the same conditions but in the absence of the protein.

In some embodiments, the plasma kallikrein binding protein has an apparent inhibition constant ($K_{i,app}$) of less than 1000, 500, 100, or 10 nM.

In one embodiment, the HC and LC variable domain sequences are components of the same polypeptide chain.

In another embodiment, the HC and LC variable domain sequences are components of different polypeptide chains. For example, the protein is an IgG., e.g., IgG1, IgG2, IgG3, or IgG4. The protein can be a soluble Fab (sFab).

In other implementations the protein includes a Fab2', scFv, minibody, scFv::Fc fusion, Fab::HSA fusion, HSA::Fab fusion, Fab::HSA::Fab fusion, or other molecule that comprises the antigen combining site of one of the binding proteins herein. The VH and VL regions of these Fabs can be provided as IgG, Fab, Fab2, Fab2', scFv, PEGylated Fab, PEGylated scFv, PEGylated Fab2, VH::CH1::HSA+LC, HSA::VH::CH1+LC, LC::HSA+VH::CH1, HSA::LC+VH::CH1, or other appropriate construction.

In one embodiment, the protein is a human or humanized antibody or is non-immunogenic in a human. For example, the protein includes one or more human antibody framework regions, e.g., all human framework regions.

In one embodiment, the protein includes a human Fc domain, or an Fc domain that is at least 95, 96, 97, 98, or 99% identical to a human Fc domain.

In one embodiment, the protein is a primate or primatized antibody or is non-immunogenic in a human. For example, the protein includes one or more primate antibody framework regions, e.g., all primate framework regions.

In one embodiment, the protein includes a primate Fc domain, or an Fc domain that is at least 95, 96, 97, 98, or 99% identical to a primate Fc domain. "Primate" includes humans (*Homo sapiens*), chimpanzees (*Pan troglodytes* and *Pan paniscus* (bonobos)), gorillas (*Gorilla gorilla*), gibons, monkeys, lemurs, aye-ayes (*Daubentonia madagascariensis*), and tarsiers.

In one embodiment, the protein includes human framework regions, or framework regions that are at least 95, 96, 97, 98, or 99% identical to human framework regions.

In certain embodiments, the protein includes no sequences from mice or rabbits (e.g., is not a murine or rabbit antibody).

In some embodiments, the mucositis is selected from the group consisting of oral, esophageal, pharyngeal and gastrointestinal mucositis.

In some embodiments, the mucositis is oral mucositis.

In some embodiments, the method further comprises administering palifermin.

In one aspect, the invention provides a kit for the treatment of mucositis. The kit includes an isolated inhibitor of kallikrein, and instructions for administering the inhibitor to a subject (e.g., patient) having mucositis or who is at risk for developing mucositis. In one embodiment, the kit further includes instructions for administration of an additional therapeutic for the treatment of mucositis (e.g., perlifermin), and may optionally contain the additional therapeutic. In one embodiment, the instructions provide a dosing regimen, dosing schedule, and/or route of administration of the inhibitor of kallikrein that differs from the dosing regimen, dosing schedule and/or route of administration for the inhibitor in the absence of the additional therapeutic. A subject (e.g., patient) who is at risk for developing mucositis can be, e.g., a subject who will be undergoing, is undergoing, or will be undergoing a chemotherapy (e.g., high-dose chemotherapy) and/or radiotherapy regimen. As another example, a subject (e.g., patient) who is at risk for developing mucositis can be, e.g., a subject who has been diagnosed with cancer, e.g., cancer of the head or neck.

In some embodiments, the mucositis is selected from the group consisting of oral, esophageal, pharyngeal and gastrointestinal mucositis.

In some embodiments, the mucositis is oral mucositis.

In some aspects, the disclosure features a kit, wherein the kit comprises:

a container comprising a isolated kallikrein inhibitor; and instructions for use of said kallikrein inhibitor for the treatment of mucositis.

In some embodiments, the kit further comprises a container comprising palifermin.

In some embodiments, the mucositis is selected from the group consisting of oral, esophageal, pharyngeal and gastrointestinal mucositis.

In some embodiments, the mucositis is oral mucositis.

In some aspects, the disclosure features a composition comprising a therapeutically effective amount of the isolated kallikrein inhibitor described herein and a therapeutically effective amount of palifermin.

In another aspect, provided herein is the use of an isolated kallikrein inhibitor for the manufacture of a medicament for the treatment and/or prevention of mucositis.

The details of one or more embodiments of the invention are set forth in the accompanying drawings and the description below. Other features, objects, and advantages of the invention will be apparent from the description and drawings, and from the claims.

The contents of all references, pending patent applications and published patents, cited throughout this application are hereby expressly incorporated by reference.

BRIEF DESCRIPTION OF THE FIGURES

FIG. 1 shows a portion of a DNA and corresponding deduced amino acid for an exemplary kallikrein inhibitor polypeptide in plasmid pPIC-K503. The inserted DNA encodes the matα Prepro signal peptide of Saccharomyces cerevisiae (underlined) fused in frame to the amino terminus of the PEP-1 (DX-88) polypeptide having the amino acid sequence enclosed by the boxed area. The amino acid sequence of the PEP-1 polypeptide shown in the boxed region is SEQ ID NO:2, and the corresponding nucleotide coding sequence is SEQ ID NO:3. The dashed arrows indicate the location and direction of two PCR primer sequences in AOX regions that were used to produce sequencing templates. DNA sequence for the entire nucleotide sequence of the figure includes the structural coding sequence for the fusion protein and is designated SEQ ID NO:27 (encoded amino acid sequence disclosed as SEQ ID NO: 1761). The double underlined portion of the sequence indicates a diagnostic probe sequence. BstB I and EcoR I indicate locations of their respective palindromic, hexameric, restriction endonuclease sites in the sequence. Asterisks denote translational stop codons. See text for details.

FIGS. 2A and 2B show an alignment of exemplary amino acid sequences, the native LACI sequence from which these variants were derived (SEQ ID NO:32), and other known Kunitz domains (SEQ ID NOS:29-31 and 33-53). Cysteine residues are shown.

FIG. 3 depicts the alignment of the light chain DNA sequence of nongermlined (X63-G06 (SEQ ID NO: 1762)) and germlined, codon optimized (X81-B01 (SEQ ID NO: 1763)) versions of the same antibody discovered using ROLIC affinity maturation. Positions indicated with an asterisk (*) are conserved, whereas blank spaces correspond to bases changed in X81-B01 due to either codon optimization or germlining.

FIG. 4 depicts the alignment of the light chain amino acid sequence of nongermlined (X63-G06 (SEQ ID NO: 1764)) and germlined, codon optimized (X81-B01 (SEQ ID NO: 1765)) versions of the same antibody discovered using ROLIC affinity maturation. Positions indicated with an asterisk (*) are conserved, whereas blank spaces correspond to amino acids changed in X81-B01 due to germlining. A total of 11 amino acids differ between the nongermlined (X63-G06) and germlined, codon optimized antibody (X81-B01).

FIG. 5 depicts the alignment of the heavy chain DNA sequence of nongermlined (X63-G06 (SEQ ID NO: 1767)) and germlined, codon optimized (X81-B01 (SEQ ID NO: 1766)) versions of the same antibody discovered using ROLIC affinity maturation. Positions indicated with an asterisk (*) are conserved, whereas blank spaces correspond to DNA bases changed in X81-B01 due to codon optimization.

FIG. 6 depicts the alignment of the heavy chain amino acid sequence of nongermlined (X63-G06 (SEQ ID NO: 1769)) and germlined, codon optimized (X81-B01 (SEQ ID NO: 1768)) versions of the same antibody discovered using ROLIC affinity maturation. Positions indicated with an asterisk (*) are conserved. The two antibodies have the same amino acid sequence in the heavy chain.

FIG. 8 discloses SEQ ID NOS 1770-1776, respectively, in order of appearance.

FIGS. 9A-9C depict ClustalW alignment of pKal sequences from different species (SEQ ID NOS 1777-1784, respectively, in order of appearance). Positions indicated by a "*" are conserved positions between, whereas positions indicated ":" indicate conservative substitutions between species. Positions indicated by a "." have nonconservative substitutions in some species. Stretches of amino acids indicated by the symbol "@" were shown to be highly solvent exposed by solvent accessible surface area calculation. Stretches of amino acids indicated by a "+" were identified as potential epitopes of antibodies listed in Table 15. Amino acids highlighted in grey were found by solvent accessible surface area calculation to be buried when complexed with a Kunitz domain active site inhibitor. The underlined positions are the amino acids that form the catalytic triad (His434, Asp483, and Ser578, numbering based on the human sequence).

DETAILED DESCRIPTION

Figure 7A:
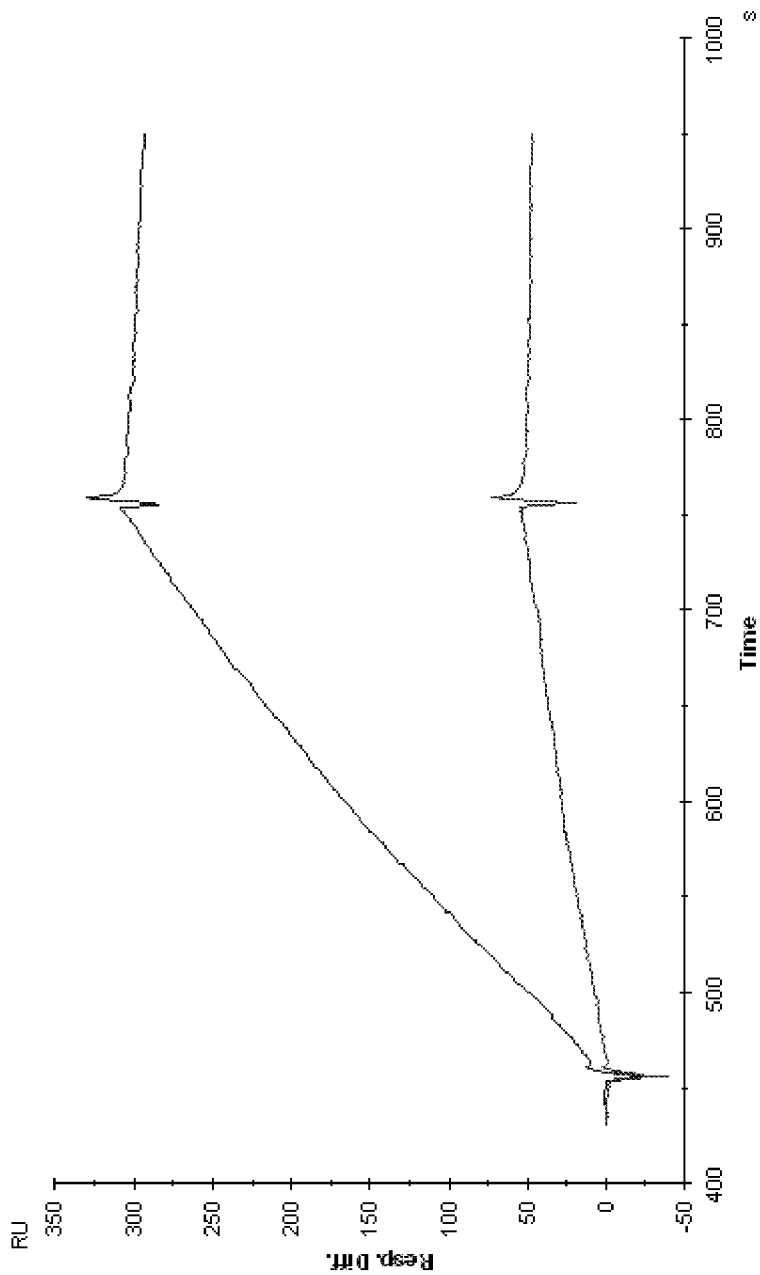
FIG. 7A depicts the EPI-KAL2 competition for X81-B01 binding pKal. X81-B01 (IgG) was captured on an anti-human Fc fragment specific surface of a CM5 BIACORE® chip. pKal (100 nM) was flowed over the surface in the presence (lower sensorgram in the figure) or absence of 1 μM EPI-KAL2 (upper sensorgram in the figure).

The inventors present herein new methods for the treatment of mucositis, for example, oral, esophageal, pharyngeal and/or gastrointestinal mucositis by the administration of an isolated kallikrein inhibitor.

Definitions

For convenience, before further description of the present invention, certain terms employed in the specification, examples and appended claims are defined here.

The singular forms "a", "an", and "the" include plural references unless the context clearly dictates otherwise.

The term "antibody" refers to a protein that includes at least one immunoglobulin variable domain or immunoglobulin variable domain sequence. For example, an antibody can include a heavy (H) chain variable region (abbreviated herein as VH), and a light (L) chain variable region (abbreviated herein as VL). In another example, an antibody includes two heavy (H) chain variable regions and two light (L) chain variable regions. The term "antibody" encompasses antigen-binding fragments of antibodies (e.g., single chain antibodies, Fab and sFab fragments, F(ab')$_2$, Fd fragments, Fv fragments, scFv, and domain antibodies (dAb) fragments (de Wildt et al., Eur J Immunol. 1996; 26 (3):629-39.)) as well as complete antibodies. An antibody can have the structural features of IgA, IgG, IgE, IgD, IgM (as well as subtypes thereof). Antibodies may be from any source, but primate (human and non-human primate) and primatized are preferred.

The VH and VL regions can be further subdivided into regions of hypervariability, termed "complementarity determining regions" ("CDR"), interspersed with regions that are more conserved, termed "framework regions" ("FR"). The extent of the framework region and CDRs has been precisely defined (see, Kabat, E. A., et al. (1991) *Sequences of Proteins of Immunological Interest*, Fifth Edition, U.S. Department of Health and Human Services, NIH Publication No. 91-3242, and Chothia, C. et al. (1987) J. Mol. Biol. 196:901-917, see also www.hgmp.mrc.ac.uk). Kabat definitions are used herein. Each VH and VL is typically composed of three CDRs and four FRs, arranged from amino-terminus to carboxy-terminus in the following order: FR1, CDR1, FR2, CDR2, FR3, CDR3, FR4.

The VH or VL chain of the antibody can further include all or part of a heavy or light chain constant region, to thereby form a heavy or light immunoglobulin chain, respectively. In one embodiment, the antibody is a tetramer of two heavy immunoglobulin chains and two light immunoglobulin chains, wherein the heavy and light immunoglobulin chains are inter-connected by, e.g., disulfide bonds. In IgGs, the heavy chain constant region includes three immunoglobulin domains, CH1, CH2 and CH3. The light chain constant region includes a CL domain. The variable region of the heavy and light chains contains a binding domain that interacts with an antigen. The constant regions of the antibodies typically mediate the binding of the antibody to host tissues or factors, including various cells of the immune system (e.g., effector cells) and the first component (Clq) of the classical complement system. The light chains of the immunoglobulin may be of types kappa or lambda. In one embodiment, the antibody is glycosylated. An antibody can be functional for antibody-dependent cytotoxicity and/or complement-mediated cytotoxicity.

One or more regions of an antibody can be human or effectively human. For example, one or more of the variable regions can be human or effectively human. For example, one or more of the CDRs can be human, e.g., HC CDR1, HC CDR2, HC CDR3, LC CDR1, LC CDR2, and LC CDR3. Each of the light chain CDRs can be human. HC CDR3 can be human. One or more of the framework regions can be human, e.g., FR1, FR2, FR3, and FR4 of the HC or LC. For example, the Fc region can be human. In one embodiment, all the framework regions are human, e.g., have a sequence of a framework of an antibody produced by a human somatic cell, e.g., a hematopoietic cell that produces immunoglobulins or a non-hematopoietic cell. In one embodiment, the human sequences are germline sequences, e.g., encoded by a germline nucleic acid. In one embodiment, the framework (FR) residues of a selected Fab can be converted to the amino-acid type of the corresponding residue in the most similar primate germline gene, especially the human germline gene. One or more of the constant regions can be human or effectively human. For example, at least 70, 75, 80, 85, 90, 92, 95, 98, or 100% of an immunoglobulin variable domain, the constant region, the constant domains (CH1, CH2, CH3, CL1), or the entire antibody can be human or effectively human.

All or part of an antibody can be encoded by an immunoglobulin gene or a segment thereof. Exemplary human immunoglobulin genes include the kappa, lambda, alpha (IgA1 and IgA2), gamma (IgG1, IgG2, IgG3, IgG4), delta, epsilon and mu constant region genes, as well as the many immunoglobulin variable region genes. Full-length immunoglobulin "light chains" (about 25 KDa or about 214 amino acids) are encoded by a variable region gene at the NH2-terminus (about 110 amino acids) and a kappa or lambda constant region gene at the COOH-terminus. Full-length immunoglobulin "heavy chains" (about 50 KDa or about 446 amino acids), are similarly encoded by a variable region gene (about 116 amino acids) and one of the other aforementioned constant region genes, e.g., gamma (encoding about 330 amino acids). The length of human HC varies considerably because HC CDR3 varies from about 3 amino-acid residues to over 35 amino-acid residues.

The term "antigen-binding fragment" of a full length antibody refers to one or more fragments of a full-length antibody that retain the ability to specifically bind to a target of interest. Examples of binding fragments encompassed within the term "antigen-binding fragment" of a full length antibody include (i) a Fab fragment, a monovalent fragment consisting of the VL, VH, CL and CH1 domains; (ii) a F(ab')$_2$ fragment, a bivalent fragment including two Fab fragments linked by a disulfide bridge at the hinge region; (iii) a Fd fragment consisting of the VH and CH1 domains; (iv) a Fv fragment consisting of the VL and VH domains of a single arm of an antibody, (v) a dAb fragment (Ward et al., (1989) *Nature* 341:544-546), which consists of a VH domain; and (vi) an isolated complementarity determining region (CDR) that retains functionality. Furthermore, although the two domains of the Fv fragment, VL and VH, are coded for by separate genes, they can be joined, using recombinant methods, by a synthetic linker that enables them to be made as a single protein chain in which the VL and VH regions pair to form monovalent molecules known as single chain Fv (scFv). See e.g., U.S. Pat. Nos. 5,260,203, 4,946,778, and 4,881,175; Bird et al. (1988) *Science* 242:423-426; and Huston et al. (1988) *Proc. Natl. Acad. Sci. USA* 85:5879-5883.

Antibody fragments can be obtained using any appropriate technique including conventional techniques known to those with skill in the art. The term "monospecific antibody" refers to an antibody that displays a single binding specificity and affinity for a particular target, e.g., epitope. This term includes a "monoclonal antibody" or "monoclonal antibody composition," which as used herein refer to a preparation of antibodies or fragments thereof of single molecular composition, irrespective of how the antibody was generated.

The inhibition constant (Ki) provides a measure of inhibitor potency; it is the concentration of inhibitor required to reduce enzyme activity by half and is not dependent on enzyme or substrate concentrations. The apparent Ki ($K_{i,app}$) is obtained at different substrate concentrations by measuring the inhibitory effect of different concentrations of inhibitor (e.g., inhibitory binding protein) on the extent of the reaction (e.g., enzyme activity); fitting the change in pseudo-first order rate constant as a function of inhibitor concentration to the Morrison equation (Equation 1) yields an estimate of the apparent Ki value. The Ki is obtained from the y-intercept extracted from a linear regression analysis of a plot of Ki,app versus substrate concentration.

$$v = v_o - v_o \left( \frac{(K_{i,app} + I + E) - \sqrt{(K_{i,app} + I + E)^2 - 4 \cdot I \cdot E}}{2 \cdot E} \right)$$ Equation 1

Where v=measured velocity; $v_0$=velocity in the absence of inhibitor; $K_{i,app}$=apparent inhibition constant; I=total inhibitor concentration; and E=total enzyme concentration.

As used herein, "binding affinity" refers to the apparent association constant or $K_a$. The $K_a$ is the reciprocal of the dissociation constant ($K_d$). A binding protein may, for example, have a binding affinity of at least $10^5$, $10^6$, $10^7$, $10^8$, $10^9$, $10^{10}$ and $10^{11}$ $M^{-1}$ for a particular target molecule. Higher affinity binding of a binding protein to a first target relative to a second target can be indicated by a higher $K_a$ (or a smaller numerical value $K_d$) for binding the first target than the $K_a$ (or numerical value $K_d$) for binding the second target. In such cases, the binding protein has specificity for the first target (e.g., a protein in a first conformation or mimic thereof) relative to the second target (e.g., the same protein in a second conformation or mimic thereof; or a second protein). Differences in binding affinity (e.g., for specificity or other comparisons) can be at least 1.5, 2, 3, 4, 5, 10, 15, 20, 37.5, 50, 70, 80, 91, 100, 500, 1000, or $10^5$ fold.

Binding affinity can be determined by a variety of methods including equilibrium dialysis, equilibrium binding, gel filtration, ELISA, surface plasmon resonance, or spectroscopy (e.g., using a fluorescence assay). Exemplary conditions for evaluating binding affinity are in TRIS-buffer (50 mM TRIS, 150 mM NaCl, 5 mM $CaCl_2$ at pH7.5). These techniques can be used to measure the concentration of bound and free binding protein as a function of binding protein (or target) concentration. The concentration of bound binding protein ([Bound]) is related to the concentration of free binding protein ([Free]) and the concentration of binding sites for the binding protein on the target where (N) is the number of binding sites per target molecule by the following equation:

[Bound]=N·[Free]/((1/Ka)+[Free]).

It is not always necessary to make an exact determination of $K_a$, though, since sometimes it is sufficient to obtain a quantitative measurement of affinity, e.g., determined using a method such as ELISA or FACS analysis, is proportional to $K_a$, and thus can be used for comparisons, such as determining whether a higher affinity is, e.g., 2-fold higher, to obtain a qualitative measurement of affinity, or to obtain an inference of affinity, e.g., by activity in a functional assay, e.g., an in vitro or in vivo assay.

The term "binding protein" refers to a protein that can interact with a target molecule. This term is used interchangeably with "ligand." A "plasma kallikrein binding protein" refers to a protein that can interact with (e.g., bind) plasma kallikrein, and includes, in particular, proteins that preferentially or specifically interact with and/or inhibit plasma kallikrein. A protein inhibits plasma kallikrein if it causes a decrease in the activity of plasma kallikrein as compared to the activity of plasma kallikrein in the absence of the protein and under the same conditions. In some embodiments, the plasma kallikrein binding protein is an antibody.

The term "kallikrein inhibitor" refers to any agent or molecule that inhibits kallikrein.

The term "combination" refers to the use of the two or more agents or therapies to treat the same patient, wherein the use or action of the agents or therapies overlap in time. The agents or therapies can be administered at the same time (e.g., as a single formulation that is administered to a patient or as two separate formulations administered concurrently) or sequentially in any order.

A "conservative amino acid substitution" is one in which the amino acid residue is replaced with an amino acid residue having a similar side chain. Families of amino acid residues having similar side chains have been defined in the art. These families include amino acids with basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine), nonpolar side chains (e.g., alanine, valine, leucine, isoleucine, proline, phenylalanine, methionine, tryptophan), beta-branched side chains (e.g., threonine, valine, isoleucine) and aromatic side chains (e.g., tyrosine, phenylalanine, tryptophan, histidine).

It is possible for one or more framework and/or CDR amino acid residues of a binding protein to include one or more mutations (e.g., substitutions (e.g., conservative substitutions or substitutions of non-essential amino acids), insertions, or deletions) relative to a binding protein described herein. A plasma kallikrein binding protein may have mutations (e.g., substitutions (e.g., conservative substitutions or substitutions of non-essential amino acids), insertions, or deletions) (e.g., at least one, two, three, or four, and/or less than 15, 12, 10, 9, 8, 7, 6, 5, 4, 3, or 2 mutations) relative to a binding protein described herein, e.g., mutations which do not have a substantial effect on protein function. The mutations can be present in framework regions, CDRs, and/or constant regions. In some embodiments, the mutations are present in a framework region. In some embodiments, the mutations are present in a CDR. In some embodiments, the mutations are present in a constant region. Whether or not a particular substitution will be tolerated, i.e., will not adversely affect biological properties, such as binding activity can be predicted, e.g., by evaluating whether the mutation is conservative or by the method of Bowie, et al. (1990) Science 247:1306-1310.

An "effectively human" immunoglobulin variable region is an immunoglobulin variable region that includes a sufficient number of human framework amino acid positions such that the immunoglobulin variable region does not elicit an immunogenic response in a normal human. An "effectively human" antibody is an antibody that includes a sufficient number of human amino acid positions such that the antibody does not elicit an immunogenic response in a normal human.

An "epitope" refers to the site on a target compound that is bound by a binding protein (e.g., an antibody such as a Fab or full length antibody). In the case where the target compound is a protein, the site can be entirely composed of amino acid components, entirely composed of chemical modifications of amino acids of the protein (e.g., glycosyl moieties), or composed of combinations thereof. Overlapping epitopes include at least one common amino acid residue, glycosyl group, phosphate group, sulfate group, or other molecular feature.

A first binding protein (e.g., antibody) "binds to the same epitope" as a second binding protein (e.g., antibody) if the first binding protein binds to the same site on a target compound that the second binding protein binds, or binds to a site that overlaps (e.g., 50%, 60%, 70%, 80%, 90%, or 100% overlap, e.g., in terms of amino acid sequence or other molecular feature (e.g., glycosyl group, phosphate group, or sulfate group)) with the site that the second binding protein binds.

A first binding protein (e.g., antibody) "competes for binding" with a second binding protein (e.g., antibody) if the binding of the first binding protein to its epitope decreases (e.g., by 10%, 20%, 30%, 40%, 50%, 60%, 70%, 80%, 90%, 100%, or more) the amount of the second binding protein that binds to its epitope. The competition can be direct (e.g., the first binding protein binds to an epitope that is the same as, or overlaps with, the epitope bound by the second binding protein), or indirect (e.g., the binding of the first binding protein to its epitope causes a steric change in the target compound that decreases the ability of the second binding protein to bind to its epitope).

Calculations of "homology" or "sequence identity" between two sequences (the terms are used interchangeably herein) are performed as follows. The sequences are aligned for optimal comparison purposes (e.g., gaps can be introduced in one or both of a first and a second amino acid or nucleic acid sequence for optimal alignment and non-homologous sequences can be disregarded for comparison purposes). The optimal alignment is determined as the best score using the GAP program in the GCG software package with a Blossum 62 scoring matrix with a gap penalty of 12, a gap extend penalty of 4, and a frameshift gap penalty of 5. The amino acid residues or nucleotides at corresponding amino acid positions or nucleotide positions are then compared. When a position in the first sequence is occupied by the same amino acid residue or nucleotide as the corresponding position in the second sequence, then the molecules are identical at that position (as used herein amino acid or nucleic acid "identity" is equivalent to amino acid or nucleic acid "homology"). The percent identity between the two sequences is a function of the number of identical positions shared by the sequences.

In a preferred embodiment, the length of a reference sequence aligned for comparison purposes is at least 30%, preferably at least 40%, more preferably at least 50%, even more preferably at least 60%, and even more preferably at least 70%, 80%, 90%, 92%, 95%, 97%, 98%, or 100% of the length of the reference sequence. For example, the reference sequence may be the length of the immunoglobulin variable domain sequence.

A "humanized" immunoglobulin variable region is an immunoglobulin variable region that is modified to include a sufficient number of human framework amino acid positions such that the immunoglobulin variable region does not elicit an immunogenic response in a normal human. Descriptions of "humanized" immunoglobulins include, for example, U.S. Pat. No. 6,407,213 and U.S. Pat. No. 5,693,762.

As used herein, the term "hybridizes under low stringency, medium stringency, high stringency, or very high stringency conditions" describes conditions for hybridization and washing. Guidance for performing hybridization reactions can be found in *Current Protocols in Molecular Biology*, John Wiley & Sons, N.Y. (1989), 6.3.1-6.3.6. Aqueous and non-aqueous methods are described in that reference and either can be used. Specific hybridization conditions referred to herein are as follows: (1) low stringency hybridization conditions in 6× sodium chloride/sodium citrate (SSC) at about 45° C., followed by two washes in 0.2×SSC, 0.1% SDS at least at 50° C. (the temperature of the washes can be increased to 55° C. for low stringency conditions); (2) medium stringency hybridization conditions in 6×SSC at about 45° C., followed by one or more washes in 0.2×SSC, 0.1% SDS at 60° C.; (3) high stringency hybridization conditions in 6×SSC at about 45° C., followed by one or more washes in 0.2×SSC, 0.1% SDS at 65° C.; and (4) very high stringency hybridization conditions are 0.5M sodium phosphate, 7% SDS at 65° C., followed by one or more washes at 0.2×SSC, 1% SDS at 65° C. Very high stringency conditions (4) are the preferred conditions and the ones that should be used unless otherwise specified. The disclosure includes nucleic acids that hybridize with low, medium, high, or very high stringency to a nucleic acid described herein or to a complement thereof, e.g., nucleic acids encoding a binding protein described herein. The nucleic acids can be the same length or within 30, 20, or 10% of the length of the reference nucleic acid. The nucleic acid can correspond to a region encoding an immunoglobulin variable domain sequence described herein.

An "isolated composition" refers to a composition that is removed from at least 90% of at least one component of a natural sample from which the isolated composition can be obtained. Compositions produced artificially or naturally can be "compositions of at least" a certain degree of purity if the species or population of species of interests is at least 5, 10, 25, 50, 75, 80, 90, 92, 95, 98, or 99% pure on a weight-weight basis.

An "isolated" protein refers to a protein that is removed from at least 90% of at least one component of a natural sample from which the isolated protein can be obtained. Proteins can be "of at least" a certain degree of purity if the species or population of species of interest is at least 5, 10, 25, 50, 75, 80, 90, 92, 95, 98, or 99% pure on a weight-weight basis.

The term "mucositis" refers to inflammation of any of the mucous membranes lining the digestive tract from the mouth on down to the anus. Mucositis is a common side effect of chemotherapy and of radiotherapy that involves any part of the digestive tract. "Oral mucositis" refers to mucositis that affects the mucous membranes lining the mouth. "Esophageal mucositis" refers to mucositis that affects the mucous membranes of the esophagus, whereas "pharyngeal mucositis" refers to mucositis that affects the mucous membranes of the pharynx. "Gastrointestinal mucositis" refers to mucositis that affects the mucous membranes of the gastrointestinal tract.

A "non-essential" amino acid residue is a residue that can be altered from the wild-type sequence of the binding agent, e.g., the antibody, without abolishing or more preferably, without substantially altering a biological activity, whereas changing an "essential" amino acid residue results in a substantial loss of activity.

A "patient", "subject" or "host" (these terms are used interchangeably) to be treated by the subject method may mean either a human or non-human animal.

The term "kallikrein" (e.g., tissue and plasma kallikrein) refers to peptidases (enzymes that cleave peptide bonds in proteins), a subgroup of the serine protease family. There are 15 known tissue kallikreins (KLK1, KLK2, KLK3, KLK4, KLK5, KLK6, KLK7, KLK8, KLK9, KLK10, KLK11, KLK12, KLK13, KLK14 and KLK15) and a single plasma kallikrein (KLKb1). Both plasma kallikrein and tissue kallikrein 1 (KLK1) cleave kininogen to generate kinins, potent pro-inflammatory peptides. DX-88 (also referred to herein as "PEP-1") is a potent (Ki<1 nM) and specific inhibitor of plasma kallikrein (NP_000883). (See also e.g., WO 95/21601 or WO 2003/103475).

The amino acid sequence of KLKb1 (plasma kallikrein) is:

stracheal, subcutaneous, subcuticular, intraarticular, subcapsular, subarachnoid, intraspinal, epidural and intrasternal injection and infusion.

The term "preventing" a disease in a subject refers to subjecting the subject to a pharmaceutical treatment, e.g., the administration of a drug, such that at least one symptom of the disease is prevented, that is, administered prior to clinical manifestation of the unwanted condition (e.g., disease or other unwanted state of the host animal) so that it protects the host against developing the unwanted condition. "Preventing" a disease may also be referred to as "prophylaxis" or "prophylactic treatment."

A "prophylactically effective amount" refers to an amount effective, at dosages and for periods of time necessary, to achieve the desired prophylactic result. Typically, because a prophylactic dose is used in subjects prior to or at an earlier stage of disease, the prophylactically effective amount is likely but not necessarily less than the therapeutically effective amount.

As used herein, the term "substantially identical" (or "substantially homologous") is used herein to refer to a first amino acid or nucleic acid sequence that contains a sufficient num-

```
                                                             (SEQ ID NO: 23)
KLKb1
>gi|78191798|ref|NP_000883.2|plasma kallikrein B1 precursor
[Homo sapiens]
MILFKQATYFISLFATVSCGCLTQLYENAFFRGGDVASMYTPNAQYCQMRCTFHPRCLLFSFLPA

SSINDMEKRFGCFLKDSVTGTLPKVHRTGAVSGHSLKQCGHQISACHRDIYKGVDMRGVNFNVSKVSSVEE

CQKRCTSNIRCQFFSYATQTFHKAEYRNNCLLKYSPGGTPTAIKVLSNVESGFSLKPCALSEIGCHMNIFQ

HLAFSDVDVARVLTPDAFVCRTICTYHPNCLFFTFYTNVWKIESQRNVCLLKTSESGTPSSSTPQENTISG

YSLLTCKRTLPEPCHSKIYPGVDFGGEELNVTFVKGVNVCQETCTKMIRCQFFTYSLLPEDCKEEKCKCFL

RLSMDGSPTRIAYGTQGSSGYSLRLCNTGDNSVCTTKTSTRIVGGTNSSWGEWPWQVSLQVKLTAQRHLCG

GSLIGHQWVLTAAHCFDGLPLQDVWRIYSGILNLSDITKDTPFSQIKEIIIHQNYKVSEGNHDIALIKLQA

PLNYTEFQKPICLPSKGDTSTIYTNCWVTGWGFSKEKGEIQNILQKVNIPLVTNEECQKRYQDYKITQRMV

CAGYKEGGKDACKGDSGGPLVCKHNGMWRLVGITSWGEGCARREQPGVYTKVAEYMDWILEKTQSSDGKAQ

MQSPA
```

DX-2300 and related antibodies are potent and specific inhibitors of tissue kallikrein 1 (AAH05313.1). DX-2300 (also referred to as "M0131-F07") is described in U.S. Pat. No. 7,329,737.

```
KLK1
>gi|13529059|gb|AAH05313.1|Kallikrein 1
[Homo sapiens]
MWFLVLCLALSLGGTGAAPPIQSRIVGGWECEQHSQPWQAALYHFSTFQC

GGILVHRQWVLTAAHCISDNYQLWLGRHNLFDDENTAQFVHVSESFPHPG

FNMSLLENHTRQADEDYSHDLMLLRLTEPADTITDAVKVVELPTQEPEVG

STCLASGWGSIEPENFSFPDDLQCVDLKILPNDECKKVHVQKVTDFMLCV

GHLEGGKDTCVGDSGGPLMCDGVLQGVTSWGYVPCGTPNKPSVAVRVLSY

VKWIEDTIAENS
```

The phrases "parenteral administration" and "administered parenterally" as used herein means modes of administration other than enteral and topical administration, usually by injection, and includes, without limitation, intravenous, intramuscular, intraarterial, intrathecal, intracapsular, intraorbital, intracardiac, intradermal, intraperitoneal, tranber of identical or equivalent (e.g., with a similar side chain, e.g., conserved amino acid substitutions) amino acid residues or nucleotides to a second amino acid or nucleic acid sequence such that the first and second amino acid or nucleic acid sequences have (or encode proteins having) similar activities, e.g., a binding activity, a binding preference, or a biological activity. In the case of antibodies, the second antibody has the same specificity and has at least 50%, at least 25%, or at least 10% of the affinity relative to the same antigen.

Sequences similar or homologous (e.g., at least about 85% sequence identity) to the sequences disclosed herein are also part of this application. In some embodiments, the sequence identity can be about 85%, 90%, 91%, 92%, 93%, 94%, 95%, 96%, 97%, 98%, 99% or higher. In some embodiments, a plasma kallikrein binding protein can have about 85%, 90%, 91%, 92%, 93%, 94%, 95%, 96%, 97%, 98%, 99% or higher sequence identity to a binding protein described herein. In some embodiments, a plasma kallikrein binding protein can have about 85%, 90%, 91%, 92%, 93%, 94%, 95%, 96%, 97%, 98%, 99% or higher sequence identity in the HC and/or LC framework regions (e.g., HC and/or LC FR 1, 2, 3, and/or 4) to a binding protein described herein. In some embodiments, a plasma kallikrein binding protein can have about 85%, 90%, 91%, 92%, 93%, 94%, 95%, 96%, 97%, 98%, 99% or higher sequence identity in the HC and/or LC CDRs (e.g., HC and/or LC CDR1, 2, and/or 3) to a binding protein described herein. In some embodiments, a plasma kallikrein binding protein can have about 85%, 90%, 91%, 92%, 93%, 94%, 95%, 96%, 97%, 98%, 99% or higher sequence identity in the constant region (e.g., CH1, CH2, CH3, and/or CL1) to a binding protein described herein.

In addition, substantial identity exists when the nucleic acid segments hybridize under selective hybridization conditions (e.g., highly stringent hybridization conditions), to the complement of the strand. The nucleic acids may be present in whole cells, in a cell lysate, or in a partially purified or substantially pure form.

Motif sequences for biopolymers can include positions which can be varied amino acids. For example, the symbol "X" in such a context generally refers to any amino acid (e.g., any of the twenty natural amino acids) unless otherwise specified, e.g., to refer to any non-cysteine amino acid. Other allowed amino acids can also be indicated for example, using parentheses and slashes. For example, "(A/W/F/N/Q)" means that alanine, tryptophan, phenylalanine, asparagine, and glutamine are allowed at that particular position.

Statistical significance can be determined by any art known method. Exemplary statistical tests include: the Students T-test, Mann Whitney U non-parametric test, and Wilcoxon non-parametric statistical test. Some statistically significant relationships have a P value of less than 0.05 or 0.02. Particular binding proteins may show a difference, e.g., in specificity or binding, that are statistically significant (e.g., P value<0.05 or 0.02). The terms "induce", "inhibit", "potentiate", "elevate", "increase", "decrease" or the like, e.g., which denote distinguishable qualitative or quantitative differences between two states, and may refer to a difference, e.g., a statistically significant difference, between the two states.

A "therapeutically effective amount" refers to an amount effective, at dosages and for periods of time necessary, to achieve the desired therapeutic result. A therapeutically effective amount of the composition may vary according to factors such as the disease state, age, sex, and weight of the individual, and the ability of the protein to elicit a desired response in the individual. A therapeutically effective amount is also one in which any toxic or detrimental effects of the composition is outweighed by the therapeutically beneficial effects.

A "therapeutically effective dosage" preferably modulates a measurable parameter, e.g., the degree of mucositis as evaluated visually by a statistically significant degree. For example, a therapeutically effective dosage can reduce the degree of a symptom of mucositis by at least about 20%, more preferably by at least about 40%, even more preferably by at least about 60%, and still more preferably by at least about 80% as compared to the symptom prior to treatment. The ability of a compound to modulate a measurable parameter, e.g., a disease-associated parameter, can be evaluated in an animal model system predictive of efficacy in human disorders and conditions, e.g., e.g., oral mucositis in a hamster or rodent model. Alternatively, this property of a composition can be evaluated by examining the ability of the compound to modulate a parameter in vitro.

"Treating" mucositis in a subject or "treating" a subject having mucositis refers to subjecting the subject to a pharmaceutical treatment, e.g., the administration of a drug, such that at least one symptom of the disease is cured, alleviated or decreased. "Treating" mucositis may be evaluated by any one of the following parameters:

Reduction in the frequency of development of mucositis (or)

Reduction in the duration of mucositis at any given level of disease severity (or)

Reduction in the severity (grades 1-4) of development of mucositis at any time course during treatment (or)

Reduction in any of the associated signs or symptoms of mucositis, including but not limited to:

Pain

Edema

Erythema

Secondary bacterial colonization

Limitation of food consumption (solid, liquid)

Fatigue

Ability to tolerate higher or repeat doses of chemotherapy or radiation therapy in the aggregate treated population compared to aggregate non treated patient populations Kallikrein Inhibitors Kunitz Domain Inhibitors.

A number of useful inhibitors of kallikrein, either tissue and/or plasma kallikrein, include a Kunitz domain.

As used herein, a "Kunitz domain" is a polypeptide domain having at least 51 amino acids and containing at least two, and preferably three, disulfides. The domain is folded such that the first and sixth cysteines, the second and fourth, and the third and fifth cysteines form disulfide bonds (e.g., in a Kunitz domain having 58 amino acids, cysteines can be present at positions corresponding to amino acids 5, 14, 30, 38, 51, and 55, according to the number of the BPTI homologous sequences provided below, and disulfides can form between the cysteines at position 5 and 55, 14 and 38, and 30 and 51), or, if two disulfides are present, they can form between a corresponding subset of cysteines thereof. The spacing between respective cysteines can be within 7, 5, 4, 3, 2, 1 or 0 amino acids of the following spacing between positions corresponding to: 5 to 55, 14 to 38, and 30 to 51, according to the numbering of the BPTI sequence provided below. The BPTI sequence can be used as a reference to refer to specific positions in any generic Kunitz domain. Comparison of a Kunitz domain of interest to BPTI can be performed by identifying the best fit alignment in which the number of aligned cysteines in maximized.

The 3D structure (at high resolution) of the Kunitz domain of BPTI is known. One of the X-ray structures is deposited in the Brookhaven Protein Data Bank as "6PTI". The 3D structure of some BPTI homologues (Eigenbrot et al., (1990) Protein Engineering, 3(7):591-598; Hynes et al., (1990) Biochemistry, 29:10018-10022) are known. At least eighty one Kunitz domain sequences are known. Known human homologues include three Kunitz domains of LACI (Wun et al., (1988) J. Biol. Chem. 263(13):6001-6004; Girard et al., (1989) Nature, 338:518-20; Novotny et al, (1989) J. Biol. Chem., 264 (31):18832-18837) two Kunitz domains of Inter-α-Trypsin Inhibitor, APP-I (Kido et al., (1988) J. Biol. Chem., 263(34):18104-18107), a Kunitz domain from collagen, three Kunitz domains of TFPI-2 (Sprecher et al., (1994) PNAS USA, 91:3353-3357), the Kunitz domains of hepatocyte growth factor activator inhibitor type 1, the Kunitz domains of Hepatocyte growth factor activator inhibitor type 2, the Kunitz domains described in U.S. Patent Publication No.: 2004-0152633. LACI is a human serum phosphoglycoprotein with a molecular weight of 39 kDa (amino acid sequence in Table 1) containing three Kunitz domains.

TABLE 1

Exemplary Natural Kunitz Domains

```
LACI:        1 MIYTMKKVHA LWASVCLLLN LAPAPLNAds eedeehtiit dtelpplklM
(SEQ ID     51 HSFCAFKADD GPCKAIMKRF FFNIFTRQCE EFIYGGCEGN QNRFESLEEC
NO. 54)    101 KKMCTRDnan riikttlqqe kpdfCfleed pgiCrgyitr yfynnqtkqC
           151 erfkygqClq nmnnfetlee CkniCedqpn gfqvdnygtq lnavnnsltp
           201 qstkvpslfe fhgpswCltp adrglCrane nrfyynsvig kCrpfkysgC
           251 ggnennftsk qeClraCkkg fiqriskggl iktkrkrkkq rvkiayeeif
           301 vknm
```
The signal sequence (1-28) is uppercase and underscored
LACI-K1 (50-107) is uppercase
LACI-K2 (121-178) is underscored
LACI-K3 (211-270) is bold

```
BPTI                   1         2         3         4         5
(SEQ ID    12345678901234567890123456789012345678901234567890123456 78
NO: 55)    RPDFCLEPPYTGPCKARIIRYFYNAKAGLCQTFVYGGCRAKRNNFKSAEDCMRTCGGA
```

The Kunitz domains above are referred to as LACI-K1 (residues 50 to 107), LACI-K2 (residues 121 to 178), and LACI-K3 (213 to 270). The cDNA sequence of LACI is reported in Wun et al. (J. Biol. Chem., 1988, 263(13):6001-6004). Girard et al. (Nature, 1989, 338:518-20) reports mutational studies in which the P1 residues of each of the three Kunitz domains were altered. LACI-K1 inhibits Factor VIIa (F.VIIa) when F.VIIa is complexed to tissue factor and LACI-K2 inhibits Factor Xa.

Proteins containing exemplary Kunitz domains include the following, with SWISS-PROT Accession Numbers in parentheses:

A4_HUMAN (P05067), A4_MACFA (P53601), A4_MACMU (P29216),
A4_MOUSE (P12023), A4_RAT (P08592), A4_SAISC (Q95241),
AMBP_PLEPL (P36992), APP2_HUMAN (Q06481), APP2_RAT (P15943),
AXP1_ANTAF (P81547), AXP2_ANTAF (P81548), BPT1_BOVIN (P00974),
BPT2_BOVIN (P04815), CA17_HUMAN (Q02388), CA36_CHICK (P15989),
CA36_HUMAN (P12111), CRPT_BOOMI (P81162), ELAC_MACEU (O62845),
ELAC_TRIVU (Q29143), EPPI_HUMAN (O95925), EPPI_MOUSE (Q9DA01),
HTIB_MANSE (P26227), IBP_CARCR (P00993), IBPC_BOVIN (P00976),
IBPI_TACTR (P16044), IBPS_BOVIN (P00975), ICS3_BOMMO (P07481),
IMAP_DROFU (P11424), IP52_ANESU (P10280), ISC1_BOMMO (P10831),
ISC2_BOMMO (P10832), ISH1_STOHE (P31713), ISH2_STOHE (P81129),
ISIK_HELPO (P00994), ISP2_GALME (P81906), IVB1_BUNFA (P25660),
IVB1_BUNMU (P00987), IVB1_VIPAA (P00991), IVB2_BUNMU (P00989),
IVB2_DABRU (P00990), IVB2_HEMHA (P00985), IVB2_NAJNI (P00986),
IVB3_VIPAA (P00992), IVBB_DENPO (P00983), IVBC_NAJNA (P19859),
IVBC_OPHHA (P82966), IVBE_DENPO (P00984), IVBI_DENAN (P00980),
IVBI_DENPO (P00979), IVBK_DENAN (P00982), IVBK_DENPO (P00981),
IVBT_ERIMA (P24541), IVBT_NAJNA (P20229), MCPI_MELCP (P82968),
SBPI_SARBU (P26228), SPT3_HUMAN (P49223), TKD1_BOVIN (Q28201),
TKD1_SHEEP (Q29428), TXCA_DENAN (P81658), UPTI_PIG (Q29100),
AMBP_BOVIN (P00978), AMBP_HUMAN (P02760), AMBP_MERUN (Q62577),
AMBP_MESAU (Q60559), AMBP_MOUSE (Q07456), AMBP_PIG (P04366),
AMBP_RAT (Q64240), IATR_HORSE (P04365), IATR_SHEEP (P13371),
SPT1_HUMAN (O43278), SPT1_MOUSE (Q9R097), SPT2_HUMAN (O43291),
SPT2_MOUSE (Q9WU03), TFP2_HUMAN (P48307), TFP2_MOUSE (O35536),
TFPI_HUMAN (P10646), TFPI_MACMU (Q28864), TFPI_MOUSE (O54819),
TFPI_RABIT (P19761), TFPI_RAT (Q02445), YN81_CAEEL (Q03610)

A variety of methods can be used to identify a Kunitz domain from a sequence database. For example, a known amino acid sequence of a Kunitz domain, a consensus sequence, or a motif (e.g., the ProSite Motif) can be searched against the GenBank sequence databases (National Center for Biotechnology Information, National Institutes of Health, Bethesda Md.), e.g., using BLAST; against Pfam database of HMMs (Hidden Markov Models) (e.g., using default parameters for Pfam searching; against the SMART database; or against the ProDom database. For example, the Pfam Accession Number PF00014 of Pfam Release 9 provides numerous Kunitz domains and an HMM for identify Kunitz domains. A description of the Pfam database can be found in Sonhammer et al. (1997) Proteins 28(3):405-420 and a detailed description of HMMs can be found, for example, in Gribskov et al. (1990) Meth. Enzymol. 183:146-159; Gribskov et al. (1987) Proc. Natl. Acad. Sci. USA 84:4355-4358; Krogh et al. (1994) J. Mol. Biol. 235:1501-1531; and Stultz et al. (1993) Protein Sci. 2:305-314. The SMART database (Simple Modular Architecture Research Tool, EMBL, Heidelberg, Del.) of HMMs as described in Schultz et al. (1998), Proc. Natl. Acad. Sci. USA 95:5857 and Schultz et al. (2000) Nucl. Acids Res 28:231. The SMART database contains domains identified by profiling with the hidden Markov models of the HMMer2 search program (R. Durbin et al. (1998) Biological sequence analysis: probabilistic models of proteins and nucleic acids. Cambridge University Press). The database also is annotated and monitored. The ProDom protein domain database consists of an automatic compilation of homologous domains (Corpet et al. (1999), Nucl. Acids Res. 27:263-267). Current versions of ProDom are built using recursive PSI-BLAST searches (Altschul et al. (1997) Nucleic Acids Res. 25:3389-3402; Gouzy et al. (1999) Computers and Chemistry 23:333-340.) of the SWISS-PROT 38 and TREMBL protein databases. The database automatically generates a consensus sequence for each domain. Prosite lists the Kunitz domain as a motif and identifies proteins that include a Kunitz domain. See, e.g., Falquet et al. Nucleic Acids Res. 30:235-238 (2002).

Kunitz domains interact with target protease using, primarily, amino acids in two loop regions ("binding loops"). The first loop region is between about residues corresponding to amino acids 13-20 of BPTI. The second loop region is between about residues corresponding to amino acids 31-39 of BPTI. An exemplary library of Kunitz domains varies one or more amino acid positions in the first and/or second loop regions. Particularly useful positions to vary, when screening for Kunitz domains that interact with kallikrein or when selecting for improved affinity variants, include: positions 13, 15, 16, 17, 18, 19, 31, 32, 34, and 39 with respect to the sequence of BPTI. At least some of these positions are expected to be in close contact with the target protease. It is also useful to vary other positions, e.g., positions that are adjacent to the aforementioned positions in the three-dimensional structure.

The "framework region" of a Kunitz domain is defined as those residues that are a part of the Kunitz domain, but specifically excluding residues in the first and second binding loops regions, i.e., about residues corresponding to amino acids 13-20 of BPTI and 31-39 of BPTI. Conversely, residues that are not in the binding loop may tolerate a wider range of amino acid substitution (e.g., conservative and/or non-conservative substitutions).

In one embodiment, these Kunitz domains are variant forms of the looped structure including Kunitz domain 1 of human lipoprotein-associated coagulation inhibitor (LACI) protein. LACI contains three internal, well-defined, peptide loop structures that are paradigm Kunitz domains (Girard, T. et al., 1989. Nature, 338:518-520). Variants of Kunitz domain 1 of LACI described herein have been screened, isolated and bind kallikrein with enhanced affinity and specificity (see, for example, U.S. Pat. Nos. 5,795,865 and 6,057,287). These methods can also be applied to other Kunitz domain frameworks to obtain other Kunitz domains that interact with kallikrein, e.g., plasma kallikrein. Useful modulators of kallikrein function typically bind and/or inhibit kallikrein, as determined using kallikrein binding and inhibition assays.

An exemplary polypeptide that includes a Kunitz domain that inhibits plasma kallikrein has or includes the amino acid sequence defined by amino acids 3-60 of SEQ ID NO:2. Another exemplary polypeptide that includes a Kunitz domain that inhibits plasma kallikrein has or includes the amino acid sequence of SEQ ID NO:2.

An exemplary polypeptide includes the amino acid sequence:

```
                                            (SEQ ID NO: 1)
Xaa1 Xaa2 Xaa3 Xaa4 Cys Xaa6 Xaa7 Xaa8 Xaa9 Xaa10

Xaa11 Gly Xaa13 Cys Xaa15 Xaa16 Xaa17 Xaa18 Xaa19
```

-continued
```
Xaa20 Xaa21 Xaa22 Xaa23 Xaa24 Xaa25 Xaa26 Xaa27

Xaa28 Xaa29 Cys Xaa31 Xaa32 Phe Xaa34 Xaa35 Gly

Gly Cys Xaa39 Xaa40 Xaa41 Xaa42 Xaa43 Xaa44 Xaa45

Xaa46 Xaa47 Xaa48 Xaa49 Xaa50 Cys Xaa52 Xaa53

Xaa54 Cys Xaa56 Xaa57 Xaa58.
```

"Xaa" refers to a position in a peptide chain that can be any of a number of different amino acids. In a first example, Xaa can by any amino acid except cysteine. In another example, one or more of the following apply: Xaa10 can be Asp or Glu; Xaa11 can be Asp, Gly, Ser, Val, Asn, Ile, Ala or Thr; Xaa13 can be Pro, Arg, His, Asn, Ser, Thr, Ala, Gly, Lys or Gln; Xaa15 can be Arg, Lys, Ala, Ser, Gly, Met, Asn or Gln; Xaa16 can be Ala, Gly, Ser, Asp or Asn; Xaa17 can be Ala, Asn, Ser, Ile, Gly, Val, Gln or Thr; Xaa18 can be His, Leu, Gln or Ala; Xaa19 can be Pro, Gln, Leu, Asn or Ile; Xaa21 can be Trp, Phe, Tyr, His or Ile; Xaa31 can be Glu, Asp, Gln, Asn, Ser, Ala, Val, Leu, Ile or Thr; Xaa32 can be Glu, Gln, Asp Asn, Pro, Thr, Leu, Ser, Ala, Gly or Val; Xaa34 can be Ile, Thr, Ser, Val, Ala, Asn, Gly or Leu; Xaa35 can be Tyr, Trp or Phe; Xaa39 can be Glu, Gly, Ala, Ser or Asp. Amino acids Xaa6, Xaa7, Xaa8, Xaa9, Xaa20, Xaa24, Xaa25, Xaa26, Xaa27, Xaa28, Xaa29, Xaa41, Xaa42, Xaa44, Xaa46, Xaa47, Xaa48, Xaa49, Xaa50, Xaa52, Xaa53 and Xaa54 can be any amino acid.

Additionally, each of the first four (Xaa1, Xaa2, Xaa3, Xaa4) and at last three 9 Xaa56, Xaa57 or Xaa58) amino acids of SEQ ID NO:1 can optionally be present or absent and can be any amino acid, if present, e.g., any non-cysteine amino acid In one embodiment, the polypeptide has a sequence with one or more of the following properties: Xaa11 can be Asp, Gly, Ser or Val; Xaa13 can be Pro, Arg, His or Asn; Xaa15 can be Arg or Lys; Xaa16 can be Ala or Gly; Xaa17 can be Ala, Asn, Ser or Ile; Xaa18 can be His, Leu or Gln; Xaa19 can be Pro, Gln or Leu; Xaa21 can be Trp or Phe; Xaa31 is Glu; Xaa32 can be Glu or Gln; Xaa34 can be Ile, Thr or Ser; Xaa35 is Tyr; and Xaa39 can be Glu, Gly or Ala.

An exemplary polypeptide can include the following amino acids: Xaa10 is Asp; Xaa11 is Asp; Xaa13 can be Pro or Arg; Xaa15 is Arg; Xaa16 can be Ala or Gly; Xaa17 is Ala; Xaa18 is His; Xaa19 is Pro; Xaa21 is Trp; Xaa31 is Glu; Xaa32 is Glu; Xaa34 can be Ile or Ser; Xaa35 is Tyr; and Xaa39 is Gly.

It is also possible to use portions of the polypeptides described herein. For example, polypeptides could include binding domains for specific kallikrein epitopes. For example, the binding loops of Kunitz domains can by cyclized and used in isolation or can be grafted onto another domain, e.g., a framework of another Kunitz domain. It is also possible to remove one, two, three, or four amino acids from the N-terminus of an amino acid sequence described herein, and/or one, two, three, four, or five amino acids from the C-terminus of an amino acid sequence described herein.

Examples of sequences encompassed by SEQ ID NO:1 as follows (where not indicated, "Xaa" refers to any non-cysteine amino acid):

```
                                                                    (SEQ ID NO: 25)
Met His Ser Phe Cys Ala Phe Lys Ala Xaa10 Xaa11 Gly Xaa13 Cys Xaa15

Xaa16 Xaa17 Xaa18 Xaa19 Arg Xaa21 Phe Phe Asn Ile Phe Thr Arg Gln Cys Xaa31

Xaa32 Phe Xaa34 Xaa35 Gly Gly Cys Xaa39 Gly Asn Gln Asn Arg Phe Glu Ser Leu Glu
```

-continued

Glu Cys Lys Lys Met Cys Thr Arg Asp, (amino acids 3-60 of SEQ ID NO: 2)
Met His Ser Phe Cys Ala Phe Lys Ala Asp Asp Gly Pro Cys Arg Ala Ala His Pro
Arg Trp Phe Phe Asn Ile Phe Thr Arg Gln Cys Glu Glu Phe Ile Tyr Gly Gly Cys Glu Gly
Asn Gln Asn Arg Phe Glu Ser Leu Glu Glu Cys Lys Lys Met Cys Thr Arg Asp, (SEQ ID NO: 4)
Met His Ser Phe Cys Ala Phe Lys Ala Asp Asp Gly Pro Cys Lys Ala Asn His Leu
Arg Phe Phe Phe Asn Ile Phe Thr Arg Gln Cys Glu Glu Phe Ser Tyr Gly Gly Cys Gly
Gly Asn Gln Asn Arg Phe Glu Ser Leu Glu Glu Cys Lys Lys Met Cys Thr Arg Asp, (SEQ ID NO: 5)
Met His Ser Phe Cys Ala Phe Lys Ala Asp Asp Gly His Cys Lys Ala Asn His Gln
Arg Phe Phe Phe Asn Ile Phe Thr Arg Gln Cys Glu Glu Phe Thr Tyr Gly Gly Cys Gly
Gly Asn Gln Asn Arg Phe Glu Ser Leu Glu Glu Cys Lys Lys Met Cys Thr Arg Asp, (SEQ ID NO: 6)
Met His Ser Phe Cys Ala Phe Lys Ala Asp Asp Gly His Cys Lys Ala Asn His Gln
Arg Phe Phe Phe Asn Ile Phe Thr Arg Gln Cys Glu Gln Phe Thr Tyr Gly Gly Cys Ala
Gly Asn Gln Asn Arg Phe Glu Ser Leu Glu Glu Cys Lys Lys Met Cys Thr Arg Asp, (SEQ ID NO: 7)
Met His Ser Phe Cys Ala Phe Lys Ala Asp Asp Gly His Cys Lys Ala Ser Leu Pro
Arg Phe Phe Phe Asn Ile Phe Thr Arg Gln Cys Glu Glu Phe Ile Tyr Gly Gly Cys Gly Gly
Asn Gln Asn Arg Phe Glu Ser Leu Glu Glu Cys Lys Lys Met Cys Thr Arg Asp, (SEQ ID NO: 8)
Met His Ser Phe Cys Ala Phe Lys Ala Asp Asp Gly His Cys Lys Ala Asn His Gln
Arg Phe Phe Phe Asn Ile Phe Thr Arg Gln Cys Glu Glu Phe Ser Tyr Gly Gly Cys Gly
Gly Asn Gln Asn Arg Phe Glu Ser Leu Glu Glu Cys Lys Lys Met Cys Thr Arg Asp, (SEQ ID NO: 9)
Met His Ser Phe Cys Ala Phe Lys Ala Asp Asp Gly His Cys Lys Gly Ala His Leu
Arg Phe Phe Phe Asn Ile Phe Thr Arg Gln Cys Glu Glu Phe Ile Tyr Gly Gly Cys Glu Gly
Asn Gln Asn Arg Phe Glu Ser Leu Glu Glu Cys Lys Lys Met Cys Thr Arg Asp, (SEQ ID NO: 10)
Met His Ser Phe Cys Ala Phe Lys Ala Asp Asp Gly Arg Cys Lys Gly Ala His Leu
Arg Phe Phe Phe Asn Ile Phe Thr Arg Gln Cys Glu Glu Phe Ile Tyr Gly Gly Cys Glu Gly
Asn Gln Asn Arg Phe Glu Ser Leu Glu Glu Cys Lys Lys Met Cys Thr Arg Asp, (SEQ ID NO: 11)
Met His Ser Phe Cys Ala Phe Lys Ala Asp Gly Gly Arg Cys Arg Gly Ala His Pro
Arg Trp Phe Phe Asn Ile Phe Thr Arg Gln Cys Glu Glu Phe Ser Tyr Gly Gly Cys Gly
Gly Asn Gln Asn Arg Phe Glu Ser Leu Glu Glu Cys Lys Lys Met Cys Thr Arg Asp, (SEQ ID NO: 12)
Met His Ser Phe Cys Ala Phe Lys Ala Asp Asp Gly Pro Cys Arg Ala Ala His Pro
Arg Trp Phe Phe Asn Ile Phe Thr Arg Gln Cys Glu Glu Phe Ser Tyr Gly Gly Cys Gly
Gly Asn Gln Asn Arg Phe Glu Ser Leu Glu Glu Cys Lys Lys Met Cys Thr Arg Asp, (SEQ ID NO: 13)
Met His Ser Phe Cys Ala Phe Lys Ala Asp Val Gly Arg Cys Arg Gly Ala His Pro
Arg Trp Phe Phe Asn Ile Phe Thr Arg Gln Cys Glu Glu Phe Ser Tyr Gly Gly Cys Gly
Gly Asn Gln Asn Arg Phe Glu Ser Leu Glu Glu Cys Lys Lys Met Cys Thr Arg Asp, -continued (SEQ ID NO: 14)
Met His Ser Phe Cys Ala Phe Lys Ala Asp Val Gly Arg Cys Arg Gly Ala Gln Pro
Arg Phe Phe Asn Ile Phe Thr Arg Gln Cys Glu Glu Phe Ser Tyr Gly Gly Cys Gly
Gly Asn Gln Asn Arg Phe Glu Ser Leu Glu Glu Cys Lys Lys Met Cys Thr Arg Asp, (SEQ ID NO: 15)
Met His Ser Phe Cys Ala Phe Lys Ala Asp Asp Gly Ser Cys Arg Ala Ala His Leu
Arg Trp Phe Phe Asn Ile Phe Thr Arg Gln Cys Glu Glu Phe Ser Tyr Gly Gly Cys Gly
Gly Asn Gln Asn Arg Phe Glu Ser Leu Glu Glu Cys Lys Lys Met Cys Thr Arg Asp, (SEQ ID NO: 16)
Met His Ser Phe Cys Ala Phe Lys Ala Glu Gly Gly Ser Cys Arg Ala Ala His Gln
Arg Trp Phe Phe Asn Ile Phe Thr Arg Gln Cys Glu Glu Phe Ser Tyr Gly Gly Cys Gly
Gly Asn Gln Asn Arg Phe Glu Ser Leu Glu Glu Cys Lys Lys Met Cys Thr Arg Asp, (SEQ ID NO: 17)
Met His Ser Phe Cys Ala Phe Lys Ala Asp Asp Gly Pro Cys Arg Gly Ala His Leu
Arg Phe Phe Asn Ile Phe Thr Arg Gln Cys Glu Glu Phe Ser Tyr Gly Gly Cys Gly
Gly Asn Gln Asn Arg Phe Glu Ser Leu Glu Glu Cys Lys Lys Met Cys Thr Arg Asp, (SEQ ID NO: 18)
Met His Ser Phe Cys Ala Phe Lys Ala Asp Asp Gly His Cys Arg Gly Ala Leu Pro
Arg Trp Phe Phe Asn Ile Phe Thr Arg Gln Cys Glu Glu Phe Ser Tyr Gly Gly Cys Gly
Gly Asn Gln Asn Arg Phe Glu Ser Leu Glu Glu Cys Lys Lys Met Cys Thr Arg Asp, (SEQ ID NO: 19)
Met His Ser Phe Cys Ala Phe Lys Ala Asp Ser Gly Asn Cys Arg Gly Asn Leu Pro
Arg Phe Phe Asn Ile Phe Thr Arg Gln Cys Glu Glu Phe Ser Tyr Gly Gly Cys Gly
Gly Asn Gln Asn Arg Phe Glu Ser Leu Glu Glu Cys Lys Lys Met Cys Thr Arg Asp, (SEQ ID NO: 20)
Met His Ser Phe Cys Ala Phe Lys Ala Asp Ser Gly Arg Cys Arg Gly Asn His Gln
Arg Phe Phe Asn Ile Phe Thr Arg Gln Cys Glu Glu Phe Ser Tyr Gly Gly Cys Gly
Gly Asn Gln Asn Arg Phe Glu Ser Leu Glu Glu Cys Lys Lys Met Cys Thr Arg Asp, (SEQ ID NO: 21)
Met His Ser Phe Cys Ala Phe Lys Ala Asp Gly Gly Arg Cys Arg Ala Ile Gln Pro
Arg Trp Phe Phe Asn Ile Phe Thr Arg Gln Cys Glu Glu Phe Ser Tyr Gly Gly Cys Gly
Gly Asn Gln Asn Arg Phe Glu Ser Leu Glu Glu Cys Lys Lys Met Cys Thr Arg Asp, (SEQ ID NO: 22)
Met His Ser Phe Cys Ala Phe Lys Ala Asp Asp Gly Arg Cys Arg Gly Ala His Pro
Arg Trp Phe Phe Asn Ile Phe Thr Arg Gln Cys Glu Glu Phe Ser Tyr Gly Gly Cys Gly
Gly Asn Gln Asn Arg Phe Glu Ser Leu Glu Glu Cys Lys Lys Met Cys Thr Arg Asp, (SEQ ID NO: 2)
Glu Ala Met His Ser Phe Cys Ala Phe Lys Ala Asp Asp Gly Pro Cys Arg Ala Ala
His Pro Arg Trp Phe Phe Asn Ile Phe Thr Arg Gln Cys Glu Glu Phe Ile Tyr Gly Gly Cys
Glu Gly Asn Gln Asn Arg Phe Glu Ser Leu Glu Glu Cys Lys Lys Met Cys Thr Arg Asp.

Additional examples of sequence include those that differ by at least one amino acid, but fewer than seven, six, five, four, three, or two amino acids differences relative to an amino acid sequence described herein, e.g., an amino acid sequence provided above. In one embodiment, fewer than three, two, or one differences are in one of the binding loops. For example, the first binding loop may have no differences relative to an amino acid sequence described herein, e.g., an amino acid sequence provided above. In another example, neither the first nor the second binding loop differs from an amino acid sequence described herein, e.g., an amino acid sequence provided above.

FIGS. 2A and 2B provide an amino acid sequence alignment of these sequences, the native LACI sequence from which these variants were derived (SEQ ID NO:32), and other known Kunitz domains (SEQ ID NOS: 29-31 and 33-53).

Still others polypeptides that inhibit plasma kallikrein include an about 58-amino acid sequence of amino acids 3-60 of SEQ ID NO:2 or the PEP-1 polypeptide having the 60-amino acid sequence of SEQ ID NO:2. The terms "PEP-1" and "DX-88" as used herein both refer to the 60-amino acid sequence of SEQ ID NO:2. A nucleotide sequence encoding the amino acid sequence of SEQ ID NO:2 is provided in SEQ ID NO:3 (see, e.g., nucleotides 309-488 in FIG. 1). It is understood that based on the known genetic code, degenerate forms of the nucleotide sequence of SEQ ID NO:3 can be obtained by simply substituting one or more of the known degenerate codons for each amino acid encoded by the nucleotide sequence. Nucleotides 7-180 of SEQ ID NO:3, and degenerate forms thereof, encode the non-naturally occurring Kunitz domain polypeptide that includes the 58-amino acid sequence of amino acids 3-60 of SEQ ID NO:2, a related sequence, or a functional fragment thereof.

In one embodiment, the polypeptide is other than aprotinin, e.g., differs from aprotinin, by at least one, two, three, five, ten, or fifteen amino acids.

Polypeptides described herein can be made synthetically using any standard polypeptide synthesis protocol and equipment. For example, the stepwise synthesis of a polypeptide can be carried out by the removal of an amino (N) terminal-protecting group from an initial (i.e., carboxy-terminal) amino acid, and coupling thereto of the carboxyl end of the next amino acid in the sequence of the polypeptide. This amino acid is also suitably protected. The carboxyl group of the incoming amino acid can be activated to react with the N-terminus of the bound amino acid by formation into a reactive group such as formation into a carbodiimide, a symmetric acid anhydride, or an "active ester" group such as hydroxybenzotriazole or pentafluorophenyl esters. Preferred solid-phase peptide synthesis methods include the BOC method, which utilizes tert-butyloxycarbonyl as the I-amino protecting group, and the FMOC method, which utilizes 9-fluorenylmethloxycarbonyl to protect the alpha-amino of the amino acid residues. Both methods are well known to those of skill in the art (Stewart, J. and Young, J., Solid-Phase Peptide Synthesis (W. H. Freeman Co., San Francisco 1989); Merrifield, J., 1963. Am. Chem. Soc., 85:2149-2154; Bodanszky, M. and Bodanszky, A., The Practice of Peptide Synthesis (Springer-Verlag, New York 1984)). If desired, additional amino- and/or carboxy-terminal amino acids can be designed into the amino acid sequence and added during polypeptide synthesis.

Polypeptides can also be produced using recombinant technology. Recombinant methods can employ any of a number of cells and corresponding expression vectors, including but not limited to bacterial expression vectors, yeast expression vectors, baculovirus expression vectors, mammalian viral expression vectors, and the like. A polypeptide described herein can be produced by a transgenic animal, e.g., in the mammary gland of a transgenic animal. In some cases, it could be necessary or advantageous to fuse the coding sequence for a polypeptide that inhibits kallikrein (e.g., a polypeptide that includes a Kunitz domain) to another coding sequence in an expression vector to form a fusion polypeptide that is readily expressed in a host cell. Part or all of the additional sequence can be removed, e.g., by protease digestion.

An exemplary recombinant expression system for producing a polypeptide that inhibits kallikrein (e.g., a polypeptide that includes a Kunitz domain) is a yeast expression vector, which permits a nucleic acid sequence encoding the amino acid sequence for the inhibitor polypeptide to be linked in the same reading frame with a nucleotide sequence encoding the MATα prepro leader peptide sequence of *Saccharomyces cerevisiae*, which in turn is under the control of an operable yeast promoter. The resulting recombinant yeast expression plasmid can be transformed by standard methods into the cells of an appropriate, compatible yeast host, which cells are able to express the recombinant protein from the recombinant yeast expression vector. Preferably, a host yeast cell transformed with such a recombinant expression vector is also able to process the fusion protein to provide an active inhibitor polypeptide. An other exemplary yeast host for producing recombinant polypeptides is *Pichia pastoris*.

As noted above, polypeptides that inhibit kallikrein can include a Kunitz domain polypeptide described herein. Some polypeptides can include an additional flanking sequence, preferably of one to six amino acids in length, at the amino and/or carboxy-terminal end, provided such additional amino acids do not significantly diminish kallikrein binding affinity or kallikrein inhibition activity so as to preclude use in the methods and compositions described herein. Such additional amino acids can be deliberately added to express a polypeptide in a particular recombinant host cell or can be added to provide an additional function, e.g., to provide a linker to another molecule or to provide an affinity moiety that facilitates purification of the polypeptide. Preferably, the additional amino acid(s) do not include cysteine, which could interfere with the disulfide bonds of the Kunitz domain.

An exemplary Kunitz domain polypeptide includes the amino acid sequence of residues 3-60 of SEQ ID NO:2. When expressed and processed in a yeast fusion protein expression system (e.g., based on the integrating expression plasmid pHIL-D2), such a Kunitz domain polypeptide retains an additional amino terminal Glu-Ala dipeptide from the fusion with the MATalpha-prepro leader peptide sequence of *S. cerevisiae*. When secreted from the yeast host cell, most of the leader peptide is processed from the fusion protein to yield a functional polypeptide (referred to herein as "PEP-1") having the amino acid sequence of SEQ ID NO:2 (see boxed region in FIG. 1).

A typical Kunitz domain, e.g., that includes, SEQ ID NO:1, contains a number of invariant positions, e.g., positions corresponding to position 5, 14, 30, 33, 38, 45, 51 and 55 in the BPTI numbering scheme are cysteine. The spacing between these positions may vary to the extent allowable within the Kunitz domain fold, e.g., such that three disulfide bonds are formed. Other positions such as, for example, positions 6, 7, 8, 9, 20, 24, 25, 26, 27, 28, 29, 41, 42, 44, 46, 47, 48, 49, 50, 52, 53 and 54, or positions corresponding to those positions, can be any amino acid (including non-genetically encoded occurring amino acids). In a particularly preferred embodiment, one or more amino acids correspond to that of a native sequence (e.g., SEQ ID NO:32, see FIGS. 2A and 2B). In another embodiment, at least one variable position is different from that of the native sequence. In yet another preferred embodiment, the amino acids can each be individually or collectively substituted by a conservative or non-conservative amino acid substitution.

Conservative amino acid substitutions replace an amino acid with another amino acid of similar chemical nature and may have no affect on protein function. Non-conservative amino acid substitutions replace an amino acid with another amino acid of dissimilar chemical structure. Examples of conserved amino acid substitutions include, for example, Asn→Gln, Arg→Lys and Ser→Thr. In a preferred embodiment, 1, 2, 3, 4, 5, 6, 7, 8, 9, 10, 11, 12, 13, 14, 15, 16, 17, 18, 19, 20 and/or 21 of these amino acids can be independently or collectively, in any combination, selected to correspond to the corresponding position of SEQ ID NO:2.

Other positions, for example, positions 10, 11, 13, 15, 16, 17, 18, 19, 21, 22, 23, 31, 32, 34, 35, 39, 40, 43 and 45, or positions corresponding to those positions can be any of a selected set of amino acids. For example, SEQ ID NO:1 defines a set of possible sequences. Each member of this set contains, for example, a cysteine at positions 5, 14, 30, 51 and 55, and any one of a specific set of amino acids at positions 10, 11, 13, 15, 16, 17, 18, 19, 21, 22, 23, 31, 32, 34, 35, 39, 40, 43 and 45, or positions corresponding to those positions. In a preferred embodiment, 1, 2, 3, 4, 5, 6, 7, 8, 9, 10, 11, 12, 13, 14, 15, 16, 17, 18 and/or 19 of these amino acids can be independently or collectively, in any combination, selected to correspond to the corresponding position of SEQ ID NO:2. The polypeptide preferably has at least 80%, 85%, 90%, 95, 97, 98, or 99% identity to SEQ ID NO:2.

The comparison of sequences and determination of percent homology between two sequences can be accomplished using a mathematical algorithm. In a preferred embodiment, the percent homology between two amino acid sequences is determined using the Needleman and Wunsch (1970), J. Mol. Biol. 48:444-453, algorithm which has been incorporated into the GAP program in the GCG software package, using either a Blossum 62 matrix or a PAM250 matrix, and a gap weight of 16, 14, 12, 10, 8, 6, or 4 and a length weight of 1, 2, 3, 4, 5, or 6. In yet another preferred embodiment, the percent homology between two nucleotide sequences is determined using the GAP program in the GCG software package, using a NWSgapdna.CMP matrix and a gap weight of 40, 50, 60, 70, or 80 and a length weight of 1, 2, 3, 4, 5, or 6. A particularly preferred set of parameters (and the one that should be used if the practitioner is uncertain about what parameters should be applied to determine if a molecule is within a homology limitation) are a Blossum 62 scoring matrix with a gap penalty of 12, a gap extend penalty of 4, and a frameshift gap penalty of 5.

Binding Protein Inhibitors.

In other embodiments, the inhibitors of kallikrein are binding proteins, such as antibodies.

In one aspect, the disclosure features a protein (e.g., an isolated protein) that binds to plasma kallikrein (e.g., human plasma kallikrein) and includes at least one immunoglobulin variable region. For example, the protein includes a heavy chain (HC) immunoglobulin variable domain sequence and/or a light chain (LC) immunoglobulin variable domain sequence. The protein can bind to and inhibit plasma kallikrein, e.g., human plasma kallikrein.

The protein can include one or more of the following characteristics: (a) a human CDR or human framework region; (b) the HC immunoglobulin variable domain sequence comprises one or more (e.g., 1, 2, or 3) CDRs that are at least 85, 88, 89, 90, 91, 92, 93, 94, 95, 96, 97, 98, 99, or 100% identical to a CDR of a HC variable domain described herein; (c) the LC immunoglobulin variable domain sequence comprises one or more (e.g., 1, 2, or 3) CDRs that are at least 85, 88, 89, 90, 91, 92, 93, 94, 95, 96, 97, 98, 99, or 100% identical to a CDR of a LC variable domain described herein; (d) the LC immunoglobulin variable domain sequence is at least 85, 88, 89, 90, 91, 92, 93, 94, 95, 96, 97, 98, 99, or 100% identical to a LC variable domain described herein (e.g., overall or in framework regions or CDRs); (e) the HC immunoglobulin variable domain sequence is at least 85, 88, 89, 90, 91, 92, 93, 94, 95, 96, 97, 98, 99, or 100% identical to a HC variable domain described herein (e.g., overall or in framework regions or CDRs); (f) the protein binds an epitope bound by a protein described herein, or competes for binding with a protein described herein; (g) a primate CDR or primate framework region; (h) the HC immunoglobulin variable domain sequence comprises a CDR1 that differs by at least one amino acid but by no more than 2 or 3 amino acids from the CDR1 of a HC variable domain described herein; (i) the HC immunoglobulin variable domain sequence comprises a CDR2 that differs by at least one amino acid but by no more than 2, 3, 4, 5, 6, 7, or 8 amino acids from the CDR2 of a HC variable domain described herein; (j) the HC immunoglobulin variable domain sequence comprises a CDR3 that differs by at least one amino acid but by no more than 2, 3, 4, 5, or 6 amino acids from the CDR3 of a HC variable domain described herein; (k) the LC immunoglobulin variable domain sequence comprises a CDR1 that differs by at least one amino acid but by no more than 2, 3, 4, or 5 amino acids from the CDR1 of a LC variable domain described herein; (l) the LC immunoglobulin variable domain sequence comprises a CDR2 that differs by at least one amino acid but by no more than 2, 3, or 4 amino acids from the CDR2 of a LC variable domain described herein; (m) the LC immunoglobulin variable domain sequence comprises a CDR3 that differs by at least one amino acid but by no more than 2, 3, 4, or 5 amino acids from the CDR3 of a LC variable domain described herein; (n) the LC immunoglobulin variable domain sequence differs by at least one amino acid but by no more than 2, 3, 4, 5, 6, 7, 8, 9, or 10 amino acids from a LC variable domain described herein (e.g., overall or in framework regions or CDRs); and (o) the HC immunoglobulin variable domain sequence differs by at least one amino acid but by no more than 2, 3, 4, 5, 6, 7, 8, 9, or 10 amino acids from a HC variable domain described herein (e.g., overall or in framework regions or CDRs).

The plasma kallikrein binding protein may be an isolated protein (e.g., at least 70, 80, 90, 95, or 99% free of other proteins).

The plasma kallikrein binding protein may inhibit plasma kallikrein, e.g., human plasma kallikrein.

In some embodiments, the plasma kallikrein binding protein does not bind prekallikrein (e.g., human prekallikrein), but binds to the active form of plasma kallikrein (e.g., human plasma kallikrein).

In certain embodiments, the protein binds at or near the active site of the catalytic domain of plasma kallikrein, or a fragment thereof, or binds an epitope that overlaps with the active site of plasma kallikrein.

In some aspects, the protein binds the same epitope or competes for binding with a protein described herein.

In some embodiments, the protein competes with or binds the same epitope as M162-A04, M160-G12, M142-H08, X63-G06, X81-B01, X67-D03, or X67-G04.

In some embodiments, the protein binds to (e.g., positions on plasma kallikrein corresponding to) CLIPS peptide C1, C2, C3, C4, C5, C6, or C7, or more than one of these peptides, e.g., the protein binds to C5 and C6. CLIPS peptides C1-C7 are peptides in plasma kallikrein identified by CLIPS epitope mapping (see FIGS. 8 and 9A-9C). C1 corresponds to positions 55-67 of the catalytic domain, C2 to positions 81-94, C3 to positions 101-108, C4 to positions 137-151, C5 to positions 162-178, C6 to positions 186-197, and C7 to positions 214-217 of plasma kallikrein.

Figure 8:
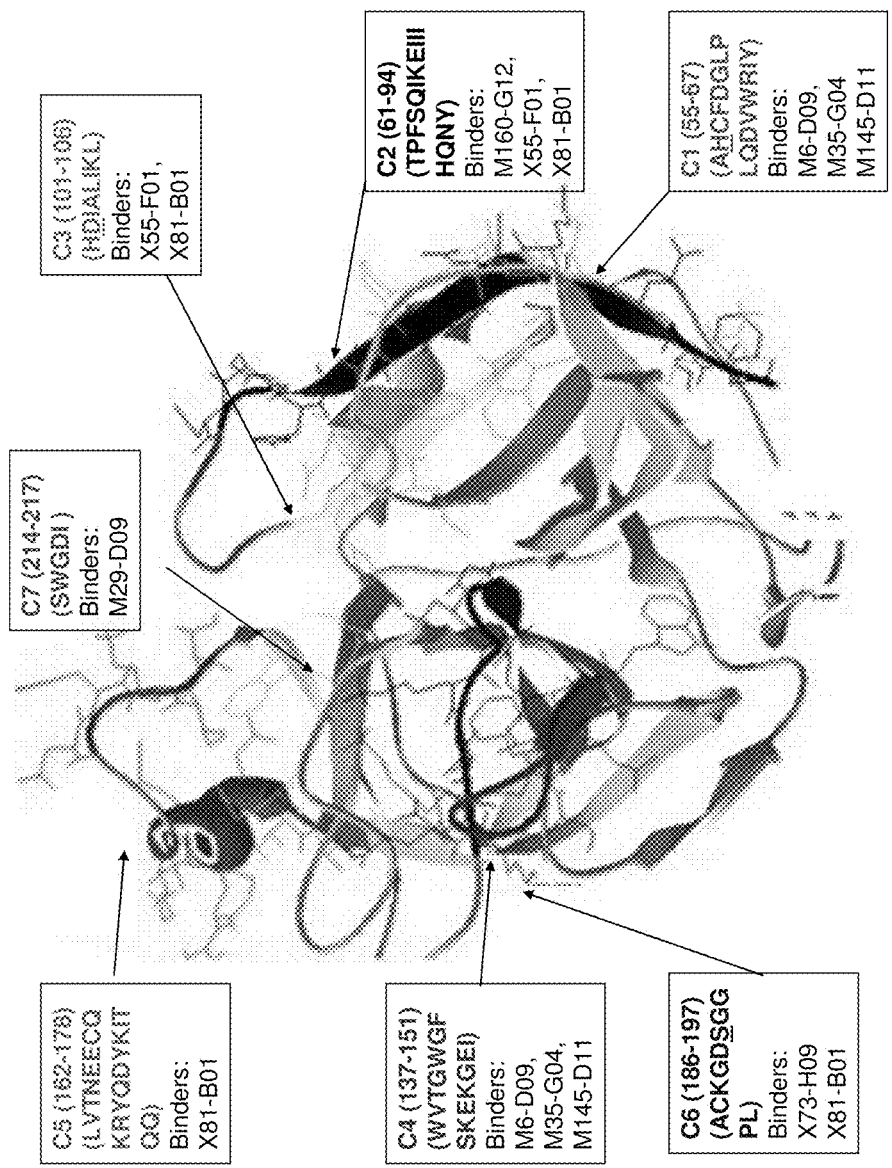
FIG. 8 depicts the results of CLIPS epitope mapping for antibodies listed in Table 15.

In some embodiments, the protein binds to an epitope shown in FIG. 8.

In some embodiments, the protein binds to one or more amino acids that form the catalytic triad of plasma kallikrein: His434, Asp483, and/or Ser578 (numbering based on the human sequence).

In some embodiments, the protein binds to one or more amino acids of Ser479, Tyr563, and/or Asp585 (numbering based on the human sequence).

The active site cleft of plasma kallikrein contains three amino acids that form the catalytic triad (His434, Asp483, and Ser578) and result in enzymatic hydrolysis of bound substrate (catalytic triad residues are underlined in FIGS. 9A-9C). The peptides selected for the CLIPS epitope mapping analysis were determined to be surface accessible and either form or surround the vicinity of the active site. Peptide C1 contains the active site histidine 434. Peptide C3 contains the active site aspartate 483. Peptide C6 contains the active site serine 578. It is possible for an antibody to bind multiple surface exposed amino acids that are discontinuous in amino acid sequence. For example, by CLIPs analysis, X81-B01 appears to bind the C2, C3, C5 and the C6 peptides.

In some embodiments, the protein binds to an epitope that includes one or more amino acids from CLIPS peptide C1, peptide C2, peptide C3, peptide C4, peptide C5, peptide C6, or peptide C7.

In some embodiments, the protein binds to an epitope that includes amino acids from at least 2 different CLIPS peptides, e.g., from at least two of peptide C1, peptide C2, peptide C3, peptide C4, peptide C5, peptide C6, or peptide C7.

The protein can bind to plasma kallikrein, e.g., human plasma kallikrein, with a binding affinity of at least $10^5$, $10^6$, $10^7$, $10^8$, $10^9$, $10^{10}$ and $10^{11}$ $M^{-1}$. In one embodiment, the protein binds to human plasma kallikrein with a $K_{off}$ slower than $1\times10^{-3}$, $5\times10^{-4}$ $s^{-1}$, or $1\times10^{-4}$ $s^{-1}$. In one embodiment, the protein binds to human plasma kallikrein with a $K_{on}$ faster than $1\times10^2$, $1\times10^3$, or $5\times10^3$ $M^{-1}s^{-1}$. In one embodiment, the protein binds to plasma kallikrein, but does not binds to tissue kallikrein and/or plasma prekallikrein (e.g., the protein binds to tissue kallikrein and/or plasma prekallikrein less effectively (e.g., 5-, 10-, 50-, 100-, or 1000-fold less or not at all, e.g., as compared to a negative control) than it binds to plasma kallikrein.

In one embodiment, the protein inhibits human plasma kallikrein activity, e.g., with a Ki of less than $10^{-5}$, $10^{-6}$, $10^{-7}$, $10^{-8}$, $10^{-9}$, and $10^{-10}$ M. The protein can have, for example, an IC50 of less than 100 nM, 10 nM or 1 nM. For example, the protein may modulate plasma kallikrein activity, as well as the production of Factor XIIa (e.g., from Factor XII) and/or bradykinin (e.g., from high-molecular-weight kininogen (HMWK)). The protein may inhibit plasma kallikrein activity, and/or the production of Factor XIIa (e.g., from Factor XII) and/or bradykinin (e.g., from high-molecular-weight kininogen (HMWK)). The affinity of the protein for human plasma kallikrein can be characterized by a $K_D$ of less than 100 nm, less than 10 nM, or less than 1 nM. In one embodiment, the protein inhibits plasma kallikrein, but does not inhibits tissue kallikrein (e.g., the protein inhibits tissue kallikrein less effectively (e.g., 5-, 10-, 50-, 100-, or 1000-fold less or not at all, e.g., as compared to a negative control) than it inhibits plasma kallikrein.

In some embodiments, the protein has an apparent inhibition constant ($K_{i,app}$) of less than 1000, 500, 100, or 10 nM.

Plasma kallikrein binding proteins may be antibodies. Plasma kallikrein binding antibodies may have their HC and LC variable domain sequences included in a single polypeptide (e.g., scFv), or on different polypeptides (e.g., IgG or Fab).

In a preferred embodiment, the protein is an antibody (e.g., a human antibody) having the light and heavy chains of antibodies selected from the group consisting of M162-A04, M160-G12, M142-H08, X63-G06, X81-B01, X67-D03, and X67-G04.

In a preferred embodiment, the protein is an antibody (e.g., a human antibody) having the heavy chain of an antibody selected from the group consisting of: M162-A04, M160-G12, M142-H08, X63-G06, X81-B01, X67-D03, and X67-G04.

In a preferred embodiment, the protein is an antibody (e.g., a human antibody) having the light chain of an antibody selected from the group consisting of: M162-A04, M160-G12, M142-H08, X63-G06, X81-B01, X67-D03, and X67-G04.

In a preferred embodiment, the protein is an antibody (e.g., a human antibody) having light and heavy antibody variable regions of an antibody selected from the group consisting of M162-A04, M160-G12, M142-H08, X63-G06, X81-B01, X67-D03, and X67-G04.

In a preferred embodiment, the protein is an antibody (e.g., a human antibody) having a heavy chain antibody variable region of an antibody selected from the group consisting of: M162-A04, M160-G12, M142-H08, X63-G06, X81-B01, X67-D03, and X67-G04.

In a preferred embodiment, the protein is an antibody (e.g., a human antibody) having a light chain antibody variable region of an antibody selected from the group consisting of: M162-A04, M160-G12, M142-H08, X63-G06, X81-B01, X67-D03, and X67-G04.

In a preferred embodiment, the protein is an antibody (e.g., a human antibody) having one or more (e.g., 1, 2, or 3) heavy chain CDRs selected from the corresponding CDRs of the group of heavy chains consisting of M162-A04, M160-G12, M142-H08, X63-G06, X81-B01, X67-D03, and X67-G04.

In a preferred embodiment, the protein is an antibody (e.g., a human antibody) having one or more (e.g., 1, 2, or 3) light chain CDRs selected from the corresponding CDRs of the group of light chains consisting of M162-A04, M160-G12, M142-H08, X63-G06, X81-B01, X67-D03, and X67-G04.

In a preferred embodiment, the protein is an antibody (e.g., a human antibody) having one or more (e.g., 1, 2, or 3) heavy chain CDRs and one or more (e.g., 1, 2, or 3) light chain CDRs selected from the corresponding CDRs of the group of light chains consisting of M162-A04, M160-G12, M142-H08, X63-G06, X81-B01, X67-D03, and X67-G04.

In one embodiment, the HC and LC variable domain sequences are components of the same polypeptide chain. In another, the HC and LC variable domain sequences are components of different polypeptide chains. For example, the protein is an IgG., e.g., IgG1, IgG2, IgG3, or IgG4. The protein can be a soluble Fab. In other implementations the protein includes a Fab2', scFv, minibody, scFv::Fc fusion, Fab::HSA fusion, HSA::Fab fusion, Fab::HSA::Fab fusion, or other molecule that comprises the antigen combining site of one of the binding proteins herein. The VH and VL regions of these Fabs can be provided as IgG, Fab, Fab2, Fab2', scFv, PEGylated Fab, PEGylated scFv, PEGylated Fab2, VH::CH1::HSA+LC, HSA::VH::CH1+LC, LC::HSA+VH::CH1, HSA::LC+VH::CH1, or other appropriate construction.

In one embodiment, the protein is a human or humanized antibody or is non-immunogenic in a human. For example, the protein includes one or more human antibody framework regions, e.g., all human framework regions, or framework regions at least 85, 88, 89, 90, 91, 92, 93, 94, 95, 96, 97, 98, 99% identical to human framework regions. In one embodiment, the protein includes a human Fc domain, or an Fc domain that is at least 95, 96, 97, 98, or 99% identical to a human Fc domain.

In one embodiment, the protein is a primate or primatized antibody or is non-immunogenic in a human. For example, the protein includes one or more primate antibody framework regions, e.g., all primate framework regions, or framework regions at least 85, 88, 89, 90, 91, 92, 93, 94, 95, 96, 97, 98, 99% identical to primate framework regions. In one embodiment, the protein includes a primate Fc domain, or an Fc domain that is at least 95, 96, 97, 98, or 99% identical to a primate Fc domain. "Primate" includes humans (*Homo sapiens*), chimpanzees (*Pan troglodytes* and *Pan paniscus* (bonobos)), gorillas (*Gorilla gorilla*), gibons, monkeys, lemurs, aye-ayes (*Daubentonia madagascariensis*), and tarsiers.

In some embodiments, the affinity of the primate antibody for human plasma kallikrein is characterized by a $K_D$ of less than 1000, 500, 100 or 10 nM, e.g., less than 10 nM or less than 1 nM.

In certain embodiments, the protein includes no sequences from mice or rabbits (e.g., is not a murine or rabbit antibody).

In some aspects, the disclosure provides the use of proteins (e.g., binding proteins, e.g., antibodies) (e.g., the proteins described herein) that bind to plasma kallikrein (e.g., human plasma kallikrein) and include at least one immunoglobin variable region in methods for treating (or preventing) mucositis. For example, the plasma kallikrein binding protein includes a heavy chain (HC) immunoglobulin variable domain sequence and a light chain (LC) immunoglobulin variable domain sequence. A number of exemplary plasma kallikrein binding proteins are described herein.

Antibodies may be discovered by screening a library using a kallikrein target, as well as by other methods. For example, kallikrein protein or a region thereof can be used as an antigen in a non-human animal, e.g., a rodent. Humanized antibodies can be generated by replacing sequences of the Fv variable region that are not directly involved in antigen binding with equivalent sequences from human Fv variable regions. General methods for generating humanized antibodies are provided by Morrison, S. L., 1985, *Science* 229:1202-1207, by Oi et al., 1986, *BioTechniques* 4:214, and by Queen et al. U.S. Pat. No. 5,585,089, U.S. Pat. No. 5,693,761 and U.S. Pat. No. 5,693,762. Those methods include isolating, manipulating, and expressing the nucleic acid sequences that encode all or part of immunoglobulin Fv variable regions from at least one of a heavy or light chain. Numerous sources of such nucleic acid are available. For example, nucleic acids may be obtained from a hybridoma producing an antibody against a predetermined target, as described above. The recombinant DNA encoding the humanized antibody, or fragment thereof, can then be cloned into an appropriate expression vector.

Immunoglobin kallikrein binding proteins (e.g., IgG or Fab kallikrein binding proteins) may be modified to reduce immunogenicity. Reduced immunogenicity is desirable in kallikrein binding proteins intended for use as therapeutics, as it reduces the chance that the subject will develop an immune response against the therapeutic molecule. Techniques useful for reducing immunogenicity of kallikrein binding proteins include deletion/modification of potential human T cell epitopes and 'germlining' of sequences outside of the CDRs (e.g., framework and Fc).

A kallikrein-binding antibody may be modified by specific deletion of human T cell epitopes or "deimmunization" by the methods disclosed in WO 98/52976 and WO 00/34317. Briefly, the heavy and light chain variable regions of an antibody are analyzed for peptides that bind to MHC Class II; these peptides represent potential T-cell epitopes (as defined in WO 98/52976 and WO 00/34317). For detection of potential T-cell epitopes, a computer modeling approach termed "peptide threading" can be applied, and in addition a database of human MHC class II binding peptides can be searched for motifs present in the VH and VL sequences, as described in WO 98/52976 and WO 00/34317. These motifs bind to any of the 18 major MHC class II DR allotypes, and thus constitute potential T cell epitopes. Potential T-cell epitopes detected can be eliminated by substituting small numbers of amino acid residues in the variable regions, or preferably, by single amino acid substitutions. As far as possible conservative substitutions are made, often but not exclusively, an amino acid common at this position in human germline antibody sequences may be used. Human germline sequences are disclosed in Tomlinson, I. A. et al., 1992, *J. Mol. Biol.* 227:776-798; Cook, G. P. et al., 1995, *Immunol. Today* Vol. 16 (5): 237-242; Chothia, D. et al., 1992, *J. Mol. Bio.* 227:799-817. The V BASE directory provides a comprehensive directory of human immunoglobulin variable region sequences (compiled by Tomlinson, I. A. et al. MRC Centre for Protein Engineering, Cambridge, UK). After the deimmunizing changes are identified, nucleic acids encoding $V_H$ and $V_L$ can be constructed by mutagenesis or other synthetic methods (e.g., de novo synthesis, cassette replacement, and so forth). Mutagenized variable sequence can, optionally, be fused to a human constant region, e.g., human IgG1 or κ constant regions.

In some cases a potential T cell epitope will include residues which are known or predicted to be important for antibody function. For example, potential T cell epitopes are usually biased towards the CDRs. In addition, potential T cell epitopes can occur in framework residues important for antibody structure and binding. Changes to eliminate these potential epitopes will in some cases require more scrutiny, e.g., by making and testing chains with and without the change. Where possible, potential T cell epitopes that overlap the CDRs were eliminated by substitutions outside the CDRs. In some cases, an alteration within a CDR is the only option, and thus variants with and without this substitution should be tested. In other cases, the substitution required to remove a potential T cell epitope is at a residue position within the framework that might be critical for antibody binding. In these cases, variants with and without this substitution should be tested. Thus, in some cases several variant deimmunized heavy and light chain variable regions were designed and various heavy/light chain combinations tested in order to identify the optimal deimmunized antibody. The choice of the final deimmunized antibody can then be made by considering the binding affinity of the different variants in conjunction with the extent of deimmunization, i.e., the number of potential T cell epitopes remaining in the variable region. Deimmunization can be used to modify any antibody, e.g., an antibody that includes a non-human sequence, e.g., a synthetic antibody, a murine antibody other non-human monoclonal antibody, or an antibody isolated from a display library.

Kallikrein binding antibodies are "germlined" by reverting one or more non-germline amino acids in framework regions to corresponding germline amino acids of the antibody, so long as binding properties are substantially retained. Similar methods can also be used in the constant region, e.g., in constant immunoglobulin domains.

Antibodies that bind to kallikrein, e.g., an antibody described herein, may be modified in order to make the variable regions of the antibody more similar to one or more germline sequences. For example, an antibody can include one, two, three, or more amino acid substitutions, e.g., in a framework, CDR, or constant region, to make it more similar to a reference germline sequence. One exemplary germlining method can include identifying one or more germline sequences that are similar (e.g., most similar in a particular database) to the sequence of the isolated antibody. Mutations (at the amino acid level) are then made in the isolated antibody, either incrementally or in combination with other mutations. For example, a nucleic acid library that includes sequences encoding some or all possible germline mutations is made. The mutated antibodies are then evaluated, e.g., to identify an antibody that has one or more additional germline residues relative to the isolated antibody and that is still useful (e.g., has a functional activity). In one embodiment, as many germline residues are introduced into an isolated antibody as possible.

In one embodiment, mutagenesis is used to substitute or insert one or more germline residues into a framework and/or constant region. For example, a germline framework and/or constant region residue can be from a germline sequence that is similar (e.g., most similar) to the non-variable region being modified. After mutagenesis, activity (e.g., binding or other functional activity) of the antibody can be evaluated to determine if the germline residue or residues are tolerated (i.e., do not abrogate activity). Similar mutagenesis can be performed in the framework regions.

Selecting a germline sequence can be performed in different ways. For example, a germline sequence can be selected if it meets a predetermined criteria for selectivity or similarity, e.g., at least a certain percentage identity, e.g., at least 75, 80, 85, 90, 91, 92, 93, 94, 95, 96, 97, 98, 99, or 99.5% identity. The selection can be performed using at least 2, 3, 5, or 10 germline sequences. In the case of CDR1 and CDR2, identifying a similar germline sequence can include selecting one such sequence. In the case of CDR3, identifying a similar germline sequence can include selecting one such sequence, but may including using two germline sequences that separately contribute to the amino-terminal portion and the carboxy-terminal portion. In other implementations more than one or two germline sequences are used, e.g., to form a consensus sequence.

In one embodiment, with respect to a particular reference variable domain sequence, e.g., a sequence described herein, a related variable domain sequence has at least 30, 40, 50, 60, 70, 80, 90, 95 or 100% of the CDR amino acid positions that are not identical to residues in the reference CDR sequences, residues that are identical to residues at corresponding positions in a human germline sequence (i.e., an amino acid sequence encoded by a human germline nucleic acid).

In one embodiment, with respect to a particular reference variable domain sequence, e.g., a sequence described herein, a related variable domain sequence has at least 30, 50, 60, 70, 80, 90 or 100% of the FR regions identical to FR sequence from a human germline sequence, e.g., a germline sequence related to the reference variable domain sequence.

Accordingly, it is possible to isolate an antibody which has similar activity to a given antibody of interest, but is more similar to one or more germline sequences, particularly one or more human germline sequences. For example, an antibody can be at least 90, 91, 92, 93, 94, 95, 96, 97, 98, 99, or 99.5% identical to a germline sequence in a region outside the CDRs (e.g., framework regions). Further, an antibody can include at least 1, 2, 3, 4, or 5 germline residues in a CDR region, the germline residue being from a germline sequence of similar (e.g., most similar) to the variable region being modified. Germline sequences of primary interest are human germline sequences. The activity of the antibody (e.g., the binding activity as measured by $K_A$) can be within a factor or 100, 10, 5, 2, 0.5, 0.1, and 0.001 of the original antibody.

Germline sequences of human immunoglobin genes have been determined and are available from a number of sources, including the international ImMunoGeneTics Information System® (IMGT), available via the world wide web at imgt-.cines.fr, and the V BASE directory (compiled by Tomlinson, I. A. et al. MRC Centre for Protein Engineering, Cambridge, UK, available via the world wide web at vbase.mrc-cpe.cam.ac.uk).

Exemplary germline reference sequences for $V_{kappa}$ include: O12/O2, O18/O8, A20, A30, L14, L1, L15, L4/18a, L5/L19, L8, L23, L9, L24, L11, L12, O11/O1, A17, A1, A18, A2, A19/A3, A23, A27, A11, L2/L16, L6, L20, L25, B3, B2, A26/A10, and A14. See, e.g., Tomlinson et al., 1995, *EMBO J.* 14(18):4628-3.

A germline reference sequence for the HC variable domain can be based on a sequence that has particular canonical structures, e.g., 1-3 structures in the H1 and H2 hypervariable loops. The canonical structures of hypervariable loops of an immunoglobulin variable domain can be inferred from its sequence, as described in Chothia et al., 1992, *J. Mol. Biol.* 227:799-817; Tomlinson et al., 1992, *J. Mol. Biol.* 227:776-798); and Tomlinson et al., 1995, *EMBO J.* 14 (18):4628-38. Exemplary sequences with a 1-3 structure include: DP-1, DP-8, DP-12, DP-2, DP-25, DP-15, DP-7, DP-4, DP-31, DP-32, DP-33, DP-35, DP-40, 7-2, hv3005, hv3005f3, DP-46, DP-47, DP-58, DP-49, DP-50, DP-51, DP-53, and DP-54.

Useful polypeptides can also be encoded by a nucleic acid that hybridizes to a nucleic acid that encodes a polypeptide described herein. The nucleic acids can hybridize under medium, high, or very high stringency conditions. As used herein, the term "hybridizes under low stringency, medium stringency, high stringency, or very high stringency conditions" describes conditions for hybridization and washing. Guidance for performing hybridization reactions can be found in *Current Protocols in Molecular Biology*, John Wiley & Sons, N.Y. (1989), 6.3.1-6.3.6, which is incorporated by reference. Aqueous and nonaqueous methods are described in that reference and either can be used. Specific hybridization conditions referred to herein are as follows: (1) low stringency hybridization conditions in 6× sodium chloride/sodium citrate (SSC) at about 45° C., followed by two washes in 0.2×SSC, 0.1% SDS at least at 50° C. (the temperature of the washes can be increased to 55° C. for low stringency conditions); (2) medium stringency hybridization conditions in 6×SSC at about 45° C., followed by one or more washes in 0.2×SSC, 0.1% SDS at 60° C.; (3) high stringency hybridization conditions in 6×SSC at about 45° C., followed by one or more washes in 0.2×SSC, 0.1% SDS at 65° C.; and (4) very high stringency hybridization conditions are 0.5M sodium phosphate, 7% SDS at 65° C., followed by one or more washes at 0.2×SSC, 1% SDS at 65° C.

Protein Production.

Standard recombinant nucleic acid methods can be used to express a protein that binds to plasma kallikrein. Generally, a nucleic acid sequence encoding the protein is cloned into a nucleic acid expression vector. Of course, if the protein includes multiple polypeptide chains, each chain can be cloned into an expression vector, e.g., the same or different vectors, that are expressed in the same or different cells.

Antibody Production.

Some antibodies, e.g., Fabs, can be produced in bacterial cells, e.g., *E. coli* cells. For example, if the Fab is encoded by sequences in a phage display vector that includes a suppressible stop codon between the display entity and a bacteriophage protein (or fragment thereof), the vector nucleic acid can be transferred into a bacterial cell that cannot suppress a stop codon. In this case, the Fab is not fused to the gene III protein and is secreted into the periplasm and/or media.

Antibodies can also be produced in eukaryotic cells. In one embodiment, the antibodies (e.g., scFv's) are expressed in a yeast cell such as *Pichia* (see, e.g., Powers et al., 2001, J. Immunol. Methods. 251:123-35), *Hanseula*, or *Saccharomyces*.

In one preferred embodiment, antibodies are produced in mammalian cells. Preferred mammalian host cells for expressing the clone antibodies or antigen-binding fragments thereof include Chinese Hamster Ovary (CHO cells) (including dhfr-CHO cells, described in Urlaub and Chasin, 1980, Proc. Natl. Acad. Sci. USA 77:4216-4220, used with a DHFR selectable marker, e.g., as described in Kaufman and Sharp, 1982, Mol. Biol. 159:601 621), lymphocytic cell lines, e.g., NS0 myeloma cells and SP2 cells, COS cells, HEK293T cells (J. Immunol. Methods (2004) 289 (1-2):65-80), and a cell from a transgenic animal, e.g., a transgenic mammal. For example, the cell is a mammary epithelial cell.

In addition to the nucleic acid sequence encoding the diversified immunoglobulin domain, the recombinant expression vectors may carry additional sequences, such as sequences that regulate replication of the vector in host cells (e.g., origins of replication) and selectable marker genes. The selectable marker gene facilitates selection of host cells into which the vector has been introduced (see e.g., U.S. Pat. Nos. 4,399, 216, 4,634,665 and 5,179,017). For example, typically the selectable marker gene confers resistance to drugs, such as G418, hygromycin or methotrexate, on a host cell into which the vector has been introduced. Preferred selectable marker genes include the dihydrofolate reductase (DHFR) gene (for use in dhfr⁻ host cells with methotrexate selection/amplification) and the neo gene (for G418 selection).

In an exemplary system for recombinant expression of an antibody, or antigen-binding portion thereof, a recombinant expression vector encoding both the antibody heavy chain and the antibody light chain is introduced into dhfr⁻ CHO cells by calcium phosphate-mediated transfection. Within the recombinant expression vector, the antibody heavy and light chain genes are each operatively linked to enhancer/promoter regulatory elements (e.g., derived from SV40, CMV, adenovirus and the like, such as a CMV enhancer/AdMLP promoter regulatory element or an SV40 enhancer/AdMLP promoter regulatory element) to drive high levels of transcription of the genes. The recombinant expression vector also carries a DHFR gene, which allows for selection of CHO cells that have been transfected with the vector using methotrexate selection/amplification. The selected transformant host cells are cultured to allow for expression of the antibody heavy and light chains and intact antibody is recovered from the culture medium. Standard molecular biology techniques are used to prepare the recombinant expression vector, transfect the host cells, select for transformants, culture the host cells and recover the antibody from the culture medium. For example, some antibodies can be isolated by affinity chromatography with a Protein A or Protein G coupled matrix.

For antibodies that include an Fc domain, the antibody production system may produce antibodies in which the Fc region is glycosylated. For example, the Fc domain of IgG molecules is glycosylated at asparagine 297 in the CH2 domain. This asparagine is the site for modification with biantennary-type oligosaccharides. It has been demonstrated that this glycosylation is required for effector functions mediated by Fcg receptors and complement C1q (Burton and Woof, 1992, Adv. Immunol. 51:1-84; Jefferis et al., 1998, Immunol. Rev. 163:59-76). In one embodiment, the Fc domain is produced in a mammalian expression system that appropriately glycosylates the residue corresponding to asparagine 297. The Fc domain can also include other eukaryotic post-translational modifications.

Antibodies can also be produced by a transgenic animal. For example, U.S. Pat. No. 5,849,992 describes a method of expressing an antibody in the mammary gland of a transgenic mammal. A transgene is constructed that includes a milk-specific promoter and nucleic acids encoding the antibody of interest and a signal sequence for secretion. The milk produced by females of such transgenic mammals includes, secreted-therein, the antibody of interest. The antibody can be purified from the milk, or for some applications, used directly.

Plasma Kallikrein

Exemplary plasma kallikrein sequences against which plasma kallikrein binding proteins may be developed can include human, mouse, or rat plasma kallikrein amino acid sequences, a sequence that is 80%, 85%, 90%, 95%, 96%, 97%, 98%, or 99% identical to one of these sequences, or a fragment thereof, e.g., of a sequence provided below.

The sequence of human plasma kallikrein that was used in selections and subsequent screening of binding proteins is shown below (accession number NP_000883.2). The human plasma kallikrein (86 kDa) that was used was purified from human plasma and activated with factor XIIa by a commercial vendor. Factor XIIa activates prekallikrein by cleaving the polypeptide sequence at a single site (between Arg371-Ile372, cleavage site marked by "/" in the sequence below) to generate active plasma kallikrein, which then consists of two disulfide linked polypeptides; a heavy chain of approximately 52 kDa and a catalytic domain of approximately 34 kDa [Colman and Schmaier, (1997) "Contact System: A Vascular Biology Modulator With Anticoagulant, Profibrinolytic, Antiadhesive, and Proinflammatory Attributes" Blood, 90, 3819-3843]

(SEQ ID NO: 26)
```
GCLTQLYENAFFRGGDVASMYTPNAQYCQMRCTFHPRCLLFSFLPASSINDMEKRFGCFLKDSVTGTLPKV

HRTGAVSGHSLKQCGHQISACHRDIYKGVDMRGVNFNVSKVSSVEECQKRCTSNIRCQFFSYATQTFHKAE

YRNNCLLKYSPGGTPTAIKVLSNVESGFSLKPCALSEIGCHMNIFQHLAFSDVDVARVLTPDAFVCRTICT

YHPNCLFFTFYTNVWKIESQRNVCLLKTSESGTPSSSTPQENTISGYSLLTCKRTLPEPCHSKIYPGVDFG

GEELNVTFVKGVNVCQETCTKMIRCQFFTYSLLPEDCKEEKCKCFLRLSMDGSPTRIAYGTQGSSGYSLRL

CNTGDNSVCTTKTSTR/IVGGTNSSWGEWPWQVSLQVKLTAQRHLCGGSLIGHQWVLTAAHCFDGLPLQDV

WRIYSGILNLSDITKDTPFSQIKEIIIHQNYKVSEGNHDIALIKLQAPLNYTEFQKPICLPSKGDTSTIYT

NCWVTGWGFSKEKGEIQNILQKVNIPLVTNEECQKRYQDYKITQRMVCAGYKEGGKDACKGDSGGPLVCKH

NGMWRLVGITSWGEGCARREQPGVYTKVAEYMDWILEKTQSSDGKAQMQSPA
```

The human, mouse, and rat prekallikrein amino acid sequences, and the mRNA sequences encoding the same, are illustrated below. The sequences of prekallikrein are the same as plasma kallikrein, except that active plasma kallikrein (pkal) has the single polypeptide chain cleaved at a single position (indicated by the "/") to generate two chains. The sequences provided below are full sequences that include signal sequences. On secretion from the expressing cell, it is expected that the signal sequences are removed.

Human plasma kallikrein (ACCESSION: NP_000883.2)

(SEQ ID NO: 28)
>gi|78191798|ref|NP_000883.2|plasma kallikrein B1 precursor [Homo sapiens]
MILFKQATYFISLFATVSCGCLTQLYENAFFRGGDVASMYTPNAQYCQMRCTFHPRCLLFSFLPASSIND

MEKRFGCFLKDSVTGTLPKVHRTGAVSGHSLKQCGHQISACHRDIYKGVDMRGVNFNVSKVSSVEECQKR

CTSNIRCQFFSYATQTFHKAEYRNNCLLKYSPGGTPTAIKVLSNVESGFSLKPCALSEIGCHMNIFQHLA

FSDVDVARVLTPDAFVCRTICTYHPNCLFFTFYTNVWKIESQRNVCLLKTSESGTPSSSTPQENTISGYS

LLTCKRTLPEPCHSKIYPGVDFGGEELNVTFVKGVNVCQETCTKMIRCQFFTYSLLPEDCKEEKCKCFLR

LSMDGSPTRIAYGTQGSSGYSLRLCNTGDNSVCTTKTSTRIVGGTNSSWGEWPWQVSLQVKLTAQRHLCG

GSLIGHQWVLTAAHCFDGLPLQDVWRIYSGILNLSDITKDTPFSQIKEIIIHQNYKVSEGNHDIALIKLQ

APLNYTEFQKPICLPSKGDTSTIYTNCWVTGWGFSKEKGEIQNILQKVNIPLVTNEECQKRYQDYKITQR

MVCAGYKEGGKDACKGDSGGPLVCKHNGMWRLVGITSWGEGCARREQPGVYTKVAEYMDWILEKTQSSDG

KAQMQSPA

Human plasma kallikrein mRNA (ACCESSION: NM_000892)

(SEQ ID NO: 56)
>gi|78191797|ref|NM_000892.3|Homo sapiens kallikrein B, plasma
(Fletcher factor) 1 (KLKB1), mRNA
AGAACAGCTTGAAGACCGTTCATTTTAAGTGACAAGAGACTCACCTCCAAGAAGCAATTGTGTTTTCAG

AATGATTTTATTCAAGCAAGCAACTTATTTCATTTCCTTGTTTGCTACAGTTTCCTGTGGATGTCTGACT

CAACTCTATGAAAACGCCTTCTTCAGAGGTGGGGATGTAGCTTCCATGTACACCCCAAATGCCCAATACT

GCCAGATGAGGTGCACATTCCACCCAAGGTGTTTGCTATTCAGTTTTCTTCCAGCAAGTTCAATCAATGA

CATGGAGAAAAGGTTTGGTTGCTTCTTGAAAGATAGTGTTACAGGAACCCTGCCAAAAGTACATCGAACA

GGTGCAGTTTCTGGACATTCCTTGAAGCAATGTGGTCATCAAATAAGTGCTTGCCATCGAGACATTTATA

AAGGAGTTGATATGAGAGGAGTCAATTTTAATGTGTCTAAGGTTAGCAGTGTTGAAGAATGCCAAAAAAG

GTGCACCAGTAACATTCGCTGCCAGTTTTTTTCATATGCCACGCAAACATTTCACAAGGCAGAGTACCGG

AACAATTGCCTATTAAAGTACAGTCCCGGAGGAACACCTACCGCTATAAAGGTGCTGAGTAACGTGGAAT

CTGGATTCTCACTGAAGCCCTGTGCCCTTTCAGAAATTGGTTGCCACATGAACATCTTCCAGCATCTTGC

GTTCTCAGATGTGGATGTTGCCAGGGTTCTCACTCCAGATGCTTTTGTGTGTCGGACCATCTGCACCTAT

CACCCCAACTGCCTCTTCTTTACATTCTATACAAATGTATGGAAAATCGAGTCACAAAGAAATGTTTGTC

TTCTTAAAACATCTGAAAGTGGCACACCAAGTTCCTCTACTCCTCAAGAAAACACCATATCTGGATATAG

CCTTTTAACCTGCAAAAGAACTTTACCTGAACCCTGCCATTCTAAAATTTACCCGGGAGTTGACTTTGGA

GGAGAAGAATTGAATGTGACTTTTGTTAAAGGAGTGAATGTTTGCCAAGAGACTTGCACAAAGATGATTC

GCTGTCAGTTTTTCACTTATTCTTTACTCCCAGAAGACTGTAAGGAAGAGAAGTGTAAGTGTTTCTTAAG

ATTATCTATGGATGGTTCTCCAACTAGGATTGCGTATGGGACACAAGGGAGCTCTGGTTACTCTTTGAGA

TTGTGTAACACTGGGGACAACTCTGTCTGCACAACAAAAACAAGCACACGCATTGTTGGAGGAACAAACT

CTTCTTGGGGAGAGTGGCCCTGGCAGGTGAGCCTGCAGGTGAAGCTGACAGCTCAGAGGCACCTGTGTGG

AGGGTCACTCATAGGACACCAGTGGGTCCTCACTGCTGCCCACTGCTTTGATGGGCTTCCCCTGCAGGAT

GTTTGGCGCATCTATAGTGGCATTTTAAATCTGTCAGACATTACAAAAGATACACCTTTCTCACAAATAA

AAGAGATTATTATTCACCAAAACTATAAAGTCTCAGAAGGGAATCATGATATCGCCTTGATAAAACTCCA

GGCTCCTTTGAATTACACTGAATTCCAAAAACCAATATGCCTACCTTCCAAAGGTGACACAAGCACAATT

-continued

```
TATACCAACTGTTGGGTAACCGGATGGGGCTTCTCGAAGGAGAAAGGTGAAATCCAAAATATTCTACAAA

AGGTAAATATTCCTTTGGTAACAAATGAAGAATGCCAGAAAAGATATCAAGATTATAAAATAACCCAACG

GATGGTCTGTGCTGGCTATAAAGAAGGGGAAAAGATGCTTGTAAGGGAGATTCAGGTGGTCCCTTAGTT

TGCAAACACAATGGAATGTGGCGTTTGGTGGGCATCACCAGCTGGGGTGAAGGCTGTGCCCGCAGGGAGC

AACCTGGTGTCTACACCAAAGTCGCTGAGTACATGGACTGGATTTTAGAGAAAACACAGAGCAGTGATGG

AAAAGCTCAGATGCAGTCACCAGCATGAGAAGCAGTCCAGAGTCTAGGCAATTTTTACAACCTGAGTTCA

AGTCAAATTCTGAGCCTGGGGGGTCCTCATCTGCAAAGCATGGAGAGTGGCATCTTCTTTGCATCCTAAG

GACGAAAAACACAGTGCACTCAGAGCTGCTGAGGACAATGTCTGGCTGAAGCCCGCTTTCAGCACGCCGT

AACCAGGGGCTGACAATGCGAGGTCGCAACTGAGATCTCCATGACTGTGTGTTGTGAAATAAAATGGTGA

AAGATCAAAAAA
```

Mouse plasma kallikrein (ACCESSION: NP_032481.1)

```
                                                        (SEQ ID NO: 57)
>gi|6680584|ref|NP_032481.1|kallikrein B, plasma 1 [Mus musculus]
MILFNRVGYFVSLFATVSCGCMTQLYKNTFFRGGDLAAIYTPDAQYCQKMCTFHPRCLLFSFLAVTPPKE

TNKRFGCFMKESITGTLPRIHRTGAISGHSLKQCGHQISACHRDIYKGLDMRGSNFNISKTDNIEECQKL

CTNNFHCQFFTYATSAFYRPEYRKKCLLKHSASGTPTSIKSADNLVSGFSLKSCALSEIGCPMDIFQHSA

FADLNVSQVITPDAFVCRTICTFHPNCLFFTFYTNEWETESQRNVCFLKTSKSGRPSPPIPQENAISGYS

LLTCRKTRPEPCHSKIYSGVDFEGEELNVTFVQGADVCQETCTKTIRCQFFIYSLLPQDCKEEGCKCSLR

LSTDGSPTRITYGMQGSSGYSLRLCKLVDSPDCTTKINARIVGGTNASLGEWPWQVSLQVKLVSQTHLCG

GSIIGRQWVLTAAHCFDGIPYPDVWRIYGGILSLSEITKETPSSRIKELIIHQEYKVSEGNYDIALIKLQ

TPLNYTEFQKPICLPSKADTNTIYTNCWVTGWGYTKEQGETQNILQKATIPLVPNEECQKKYRDYVINKQ

MICAGYKEGGTDACKGDSGGPLVCKHSGRWQLVGITSWGEGCGRKDQPGVYTKVSEYMDWILEKTQSSDV

RALETSSA
```

Mouse plasma kallikrein mRNA (ACCESSION: NM_008455.2)

```
                                                        (SEQ ID NO: 58)
>gi|236465804|ref|NM_008455.2|Mus musculus kallikrein B, plasma 1
(Klkb1), mRNA
AGACCGCCCTCGGTGCCATATTCAGAGGGCTTGAAGACCATCTTCATGTGAAGACTCCCTCTCCTCCAGA

ACCACAACGTGACCATCCTTCCAGGATGATTTTATTCAACCGAGTGGGTTATTTTGTTTCCTTGTTTGCT

ACCGTCTCCTGTGGGTGTATGACTCAACTGTATAAAAATACCTTCTTCAGAGGTGGGGATCTAGCTGCCA

TCTACACCCCAGATGCCCAGTACTGTCAGAAGATGTGCACTTTTCACCCCAGGTGCCTGCTGTTCAGCTT

TCTCGCCGTGACTCCACCCAAAGAGACAAATAAACGGTTTGGTTGCTTCATGAAAGAGAGCATTACAGGG

ACTTTGCCAAGAATACACCGGACAGGGGCCATTTCTGGTCATTCTTTAAAGCAGTGTGGCCATCAAATAA

GTGCTTGCCACCGAGACATATACAAAGGACTTGATATGAGAGGGTCCAACTTTAATATCTCTAAGACCGA

CAATATTGAAGAATGCCAGAAACTGTGCACAAATAATTTTCACTGCCAATTTTTCACATATGCTACAAGT

GCATTTTACAGACCAGAGTACCGGAAGAAGTGCCTGCTGAAGCACAGTGCAAGCGGAACACCCACCAGCA

TAAAGTCAGCGGACAACCTGGTGTCTGGATTCTCACTGAAGTCCTGTGCGCTTTCGGAGATAGGTTGCCC

CATGGATATTTTCCAGCACTCTGCCTTTGCAGACCTGAATGTAAGCCAGGTCATCACCCCCGATGCCTTT

GTGTGTCGCACCATCTGCACCTTCCATCCCAACTGCCTTTTCTTCACGTTCTACACGAATGAATGGGAGA

CAGAATCACAGAGAAATGTTTGTTTTCTTAAGACGTCTAAAAGTGGAAGACCAAGTCCCCCTATTCCTCA
```

```
-continued
AGAAAACGCTATATCTGGATATAGTCTCCTCACCTGCAGAAAAACTCGCCCTGAACCCTGCCATTCCAAA

ATTTACTCTGGAGTTGACTTTGAAGGGGAAGAACTGAATGTGACCTTCGTGCAAGGAGCAGATGTCTGCC

AAGAGACTTGTACAAAGACAATCCGCTGCCAGTTTTTTATTTACTCCTTACTCCCCAAGACTGCAAGGA

GGAGGGGTGTAAATGTTCCTTAAGGTTATCCACAGATGGCTCCCCAACTAGGATCACCTATGGCATGCAG

GGGAGCTCCGGTTATTCTCTGAGATTGTGTAAACTTGTGGACAGCCCTGACTGTACAACAAAAATAAATG

CACGTATTGTGGGAGGAACAAACGCTTCTTTAGGGGAGTGGCCATGGCAGGTCAGCCTGCAAGTGAAGCT

GGTATCTCAGACCCATTTGTGTGGAGGGTCCATCATTGGTCGCCAATGGGTACTGACAGCTGCCCATTGC

TTTGATGGAATTCCCTATCCAGATGTGTGGCGTATATATGGCGGAATTCTTAGTCTGTCCGAGATTACGA

AAGAAACGCCTTCCTCGAGAATAAAGGAGCTTATTATTCATCAGGAATACAAAGTCTCAGAAGGCAATTA

TGATATTGCCTTAATAAAGCTTCAGACGCCCCTGAATTATACTGAATTCCAAAAACCAATATGCCTGCCT

TCCAAAGCTGACACAAATACAATTTATACCAACTGTTGGGTGACTGGATGGGCTACACGAAGGAACAAG

GTGAAACGCAAAATATTCTACAAAAGGCTACTATTCCTTTGGTACCAAATGAAGAATGCCAGAAAAAATA

CAGAGATTATGTTATAAACAAGCAGATGATCTGTGCTGGCTACAAAGAAGGCGGAACAGACGCTTGTAAG

GGAGATTCCGGTGGCCCCTTAGTCTGTAAACACAGTGGACGGTGGCAGTTGGTGGGTATCACCAGCTGGG

GTGAAGGCTGCGCCCGCAAGGACCAACCAGGAGTCTACACCAAAGTTTCTGAGTACATGGACTGGATATT

GGAGAAGACACAGAGCAGTGATGTAAGAGCTCTGGAGACATCTTCAGCCTGAGGAGGCTGGGTACCAAGG

AGGAAGAACCCAGCTGGCTTTACCACCTGCCCTCAAGGCAAACTAGAGCTCCAGGATTCTCGGCTGTAAA

ATGTTGATAATGGTGTCTACCTCACATCCGTATCATTGGATTGAAAATTCAAGTGTAGATATAGTTGCTG

AAGACAGCGTTTTGCTCAAGTGTGTTTCCTGCCTTGAGTCACAGGAGCTCCAATGGGAGCATTACAAAGA

TCACCAAGCTTGTTAGGAAAGAGAATGATCAAAGGGTTTTATTAGGTAATGAAATGTCTAGATGTGATGC

AATTGAAAAAAGACCCCAGATTCTAGCACAGTCCTTGGGACCATTCTCATGTAACTGTTGACTCTGGAC

CTCAGCAGATCTCAGAGTTACCTGTCCACTTCTGACATTTGTTTATTAGAGCCTGATGCTATTCTTTCAA

GTGGAGCAAAAAAAAAAAAAAA
```

Rat plasma kallikrein (ACCESSION: NP_036857.2)

```
                                                                (SEQ ID NO: 59)
>gi|162138905|ref|NP_036857.2|kallikrein B, plasma 1 [Rattus
norvegicus]
MILFKQVGYFVSLFATVSCGCLSQLYANTFFRGGDLAAIYTPDAQHCQKMCTFHPRCLLFSFLAVSPTKE

TDKRFGCFMKESITGTLPRIHRTGAISGHSLKQCGHQLSACHQDIYEGLDMRGSNFNISKTDSIEECQKL

CTNNIHCQFFTYATKAFHRPEYRKSCLLKRSSSGTPTSIKPVDNLVSGFSLKSCALSEIGCPMDIFQHFA

FADLNVSHVVTPDAFVCRTVCTFHPNCLFFTFYTNEWETESQRNVCFLKTSKSGRPSPPIIQENAVSGYS

LFTCRKARPEPCHFKIYSGVAFEGEELNATFVQGADACQETCTKTIRCQFFTYSLLPQDCKAEGCKCSLR

LSTDGSPTRITYEAQGSSGYSLRLCKVVESSDCTTKINARIVGGTNSSLGEWPWQVSLQVKLVSQNHMCG

GSIIGRQWILTAAHCFDGIPYPDVWRIYGGILNLSEITNKTPFSSIKELIIHQKYKMSEGSYDIALIKLQ

TPLNYTEFQKPICLPSKADTNTIYTNCWVTGWGYTKERGETQNILQKATIPLVPNEECQKKYRDYVITKQ

MICAGYKEGGIDACKGDSGGPLVCKHSGRWQLVGITSWGEGCARKEQPGVYTKVAEYIDWILEKIQSSKE

RALETSPA
```

Rat plasma kallikrein mRNA (ACCESSION: NM_012725)

(SEQ ID NO: 60)
>gi|162138904|ref|NM_012725.2|*Rattus norvegicus* kallikrein B, plasma 1
(Klkb1), mRNA
TGAAGACTAGCTTCATGTGAAGACTCCTTCTCCTCCAGCAGCACAAAGCAACCATCCTTCCAGGATGATT

TTATTCAAACAAGTGGGTTATTTTGTTTCCTTGTTCGCTACAGTTTCCTGTGGGTGTCTGTCACAACTGT

ATGCAAATACCTTCTTCAGAGGTGGGGATCTGGCTGCCATCTACACCCCGGATGCCCAGCACTGTCAGAA

GATGTGCACGTTTCACCCCAGGTGCCTGCTCTTCAGCTTCCTTGCCGTGAGTCCAACCAAGGAGACAGAT

AAAAGGTTTGGGTGCTTCATGAAAGAGAGCATTACAGGGACTTTGCCAAGAATACACCGGACAGGGCCA

TTTCTGGTCATTCTTTAAAACAGTGTGGCCATCAATTAAGTGCTTGCCACCAAGACATATACGAAGGACT

GGATATGAGAGGGTCCAACTTTAATATATCTAAGACCGACAGTATTGAAGAATGCCAGAAACTGTGCACA

AATAATATTCACTGCCAATTTTTCACATATGCTACAAAAGCATTTCACAGACCAGAGTACAGGAAGAGTT

GCCTGCTGAAGCGCAGTTCAAGTGGAACGCCCACCAGTATAAAGCCAGTGGACAACCTGGTGTCTGGATT

CTCACTGAAGTCCTGTGCTCTCTCAGAGATCGGTTGCCCCATGGATATTTTCCAGCACTTTGCCTTTGCA

GACCTGAATGTAAGCCATGTCGTCACCCCCGATGCCTTCGTGTGTCGCACCGTTTGCACCTTCCATCCCA

ACTGCCTCTTCTTCACATTCTACACGAATGAGTGGGAGACGGAATCACAGAGGAATGTTTGTTTTCTTAA

GACATCTAAAAGTGGAAGACCAAGTCCCCCTATTATTCAAGAAAATGCTGTATCTGGATACAGTCTCTTC

ACCTGCAGAAAAGCTCGCCCTGAACCCTGCCATTTCAAGATTTACTCTGGAGTTGCCTTCGAAGGGGAAG

AACTGAACGCGACCTTCGTGCAGGGAGCAGATGCGTGCCAAGAGACTTGTACAAAGACCATCCGCTGTCA

GTTTTTTACTTACTCATTGCTTCCCCAAGACTGCAAGGCAGAGGGGTGTAAATGTTCCTTAAGGTTATCC

ACGGATGGCTCTCCAACTAGGATCACCTATGAGGCACAGGGGAGCTCTGGTTATTCTCTGAGACTGTGTA

AAGTTGTGGAGAGCTCTGACTGTACGACAAAAATAAATGCACGTATTGTGGGAGGAACAAACTCTTCTTT

AGGAGAGTGGCCATGGCAGGTCAGCCTGCAAGTAAAGTTGGTTTCTCAGAATCATATGTGTGGAGGGTCC

ATCATTGGACGCCAATGGATACTGACGGCTGCCCATTGCTTTGATGGGATTCCCTATCCAGACGTGTGGC

GTATATATGGCGGGATTCTTAATCTGTCAGAGATTACAAACAAAACGCCTTTCTCAAGTATAAAGGAGCT

TATTATTCATCAGAAATACAAAATGTCAGAAGGCAGTTACGATATTGCCTTAATAAAGCTTCAGACACCG

TTGAATTATACTGAATTCCAAAAACCAATATGCCTGCCTTCCAAAGCTGACACAAATACAATTTATACCA

ACTGCTGGGTGACTGGATGGGGCTACACAAAGGAACGAGGTGAGACCCAAAATATTCTACAAAAGGCAAC

TATTCCCTTGGTACCAAATGAAGAATGCCAGAAAAAATATAGAGATTATGTTATAACCAAGCAGATGATC

TGTGCTGGCTACAAAGAAGGTGGAATAGATGCTTGTAAGGGAGATTCCGGTGGCCCCTTAGTTTGCAAAC

ATAGTGGAAGGTGGCAGTTGGTGGGTATCACCAGCTGGGGCGAAGGCTGTGCCCGCAAGGAGCAACCAGG

AGTCTACACCAAAGTTGCTGAGTACATTGACTGGATATTGGAGAAGATACAGAGCAGCAAGGAAAGAGCT

CTGGAGACATCTCCAGCATGAGGAGGCTGGGTACTGATGGGAAGAGCCCAGCTGGCACCAGCTTTACCA

CCTGCCCTCAAGTCCTACTAGAGCTCCAGAGTTCTCTTCTGCAAAATGTCGATAGTGGTGTCTACCTCGC

ATCCTTACCATAGGATTAAAAGTCCAAATGTAGACACAGTTGCTAAAGACAGCGCCATGCTCAAGCGTGC

TTCCTGCCTTGAGCAACAGGAACGCCAATGAGAACTATCCAAAGATTACCAAGCCTGTTTGGAAATAAAA

TGGTCAAAGGATTTTTATTAGGTAGTGAAATTAGGTAGTTGTCCTTGGAACCATTCTCATGTAACTGTTG

ACTCTGGACCTCAGCAGATCACAGTTACCTTCTGTCCACTTCTGACATTTGTGTACTGGAACCTGATGCT

GTTCTTCCACTTGGAGCAAAGAACTGAGAAACCTGGTTCTATCCATTGGGAAAAAGAGATCTTTGTAACA

TTTCCTTTACAATAAAAAGATGTTCTACTTGGACTTGAAAAAAAAAAAAAAAAAAAAAAAAAA

Modifications

It is possible to modify polypeptides that inhibit kallikrein in a variety of ways. For example, the polypeptides can be attached to one or more polyethylene glycol moieties to stabilize the compound or prolong retention times, e.g., by at least 2, 4, 5, 8, 10, 15, 20, 50, 100, 500 or 1000 fold.

In one embodiment, a kallikrein binding protein is physically associated with a moiety that improves its stabilization and/or retention in circulation, e.g., in blood, serum, lymph, or other tissues, e.g., by at least 1.5, 2, 5, 10, or 50 fold. For example, a kallikrein binding protein can be associated with a polymer, e.g., a substantially non-antigenic polymer, such as a polyalkylene oxide or polyethylene oxide. Suitable polymers will vary substantially by weight. Polymers having molecular number average weights ranging from about 200 to about 35,000 (or about 1,000 to about 15,000, and 2,000 to about 12,500) can be used. For example, a kallikrein binding protein can be conjugated to a water soluble polymer, e.g., hydrophilic polyvinyl polymers, e.g. polyvinylalcohol and polyvinylpyrrolidone. A plurality of polymer moieties can be attached to one polypeptide, e.g., at least two, three, or four such moieties, e.g., having an average molecular weight of about 2,000 to 7,000 Daltons. A non-limiting list of such polymers include polyalkylene oxide homopolymers such as polyethylene glycol (PEG) or polypropylene glycols, polyoxyethylenated polyols, copolymers thereof and block copolymers thereof, provided that the water solubility of the block copolymers is maintained.

For example, the polypeptide can be conjugated to a water soluble polymer, e.g., a hydrophilic polyvinyl polymer, e.g. polyvinylalcohol and polyvinylpyrrolidone. A non-limiting list of such polymers include polyalkylene oxide homopolymers such as polyethylene glycol (PEG) or polypropylene glycols, polyoxyethylenated polyols, copolymers thereof and block copolymers thereof, provided that the water solubility of the block copolymers is maintained. Additional useful polymers include polyoxyalkylenes such as polyoxyethylene, polyoxypropylene, and block copolymers of polyoxyethylene and polyoxypropylene (Pluronics); polymethacrylates; carbomers; branched or unbranched polysaccharides which comprise the saccharide monomers D-mannose, D- and L-galactose, fucose, fructose, D-xylose, L-arabinose, D-glucuronic acid, sialic acid, D-galacturonic acid, D-mannuronic acid (e.g. polymannuronic acid, or alginic acid), D-glucosamine, D-galactosamine, D-glucose and neuraminic acid including homopolysaccharides and heteropolysaccharides such as lactose, amylopectin, starch, hydroxyethyl starch, amylose, dextrane sulfate, dextran, dextrins, glycogen, or the polysaccharide subunit of acid mucopolysaccharides, e.g. hyaluronic acid; polymers of sugar alcohols such as polysorbitol and polymannitol; heparin or heparan.

Other compounds can also be attached to the same polymer, e.g., a cytotoxin, a label, or another targeting agent or an unrelated agent. Mono-activated, alkoxy-terminated polyalkylene oxides (PAO's), e.g., monomethoxy-terminated polyethylene glycols (mPEG's); $C_{1-4}$ alkyl-terminated polymers; and bis-activated polyethylene oxides (glycols) can be used for crosslinking. See, e.g., U.S. Pat. No. 5,951,974.

A kallikrein binding protein can also be associated with a carrier protein, e.g., a serum albumin, such as a human serum albumin. For example, a translational fusion can be used to associate the carrier protein with the kallikrein binding protein.

Methods

Provided herein are methods and compositions for treating and/or preventing mucositis by administering an isolated inhibitor of kallikrein to a subject having, or suspected of having, or at risk of having, mucositis. A subject (e.g., patient) who is at risk for developing mucositis can be, e.g., a subject who will be undergoing, is undergoing, or will be undergoing a chemotherapy (e.g., high-dose chemotherapy) and/or radiotherapy regimen. As another example, a subject (e.g., patient) who is at risk for developing mucositis can be, e.g., a subject who has been diagnosed with cancer, e.g., cancer of the head or neck.

The methods can be practiced in humans in need of treatment for mucositis or in nonhuman subjects.

In one embodiment, a method for treatment includes administration of an isolated polypeptide comprising a Kunitz domain as the inhibitor of kallikrein. One embodiment of the method uses a polypeptide containing an amino acid sequence of SEQ ID NO:1 that has an affinity for kallikrein that is approximately 30-fold or more higher than that of a broad range serine protease, e.g., aprotinin, which is isolated from bovine lung and currently approved for use in coronary artery bypass grafting procedures (TRASYLOL™, Bayer Corporation Pharmaceutical Division, West Haven, Conn.).

Administration of an isolated kallikrein inhibitor results in improvement of, a reduction in the severity of, the prevention of, or the stabilization of at least one symptom of mucositis, such as pain, edema, erythema, secondary bacterial colonization, or limitation of food consumption. The success and/or progress of such methods for treating or preventing mucositis may be evaluated by any one of the following parameters:

Reduction in the frequency of development of mucositis (or)

Reduction in the duration of mucositis at any given level of disease severity (or)

Reduction in the severity (grades 1-4) of development of mucositis at any time course during treatment (or)

Reduction in any of the associated signs or symptoms of mucositis, including but not limited to:

Pain

Edema

Erythema

Secondary bacterial colonization

Limitation of food consumption (solid, liquid)

Fatigue

Ability to tolerate higher or repeat doses of chemotherapy or radiation therapy in the aggregate treated population compared to aggregate non treated patient populations Combination Therapy The isolated kallikrein inhibitor may be administered along with another therapeutic as part of a combination therapy for mucositis. The other therapeutic may be a supportive therapy, or a therapeutic agent, such as palifermin (KEPIVANCE®) (human keratinocyte growth factor (KGF)). Supportive treatments include sucking on ice cubes, antioxidants, and mouth rinses (e.g., GELCLAIR®, CAPHOSOL®, MUGARD®). Several mouth rinses are available that combine antihistamines, anesthetics, anti-inflammatory medications (such as corticosteroids), antibiotics, and antifungals. Narcotic analgesics may also prove to help relieve the pain. Other supportive treatments include antimicrobials, anti-inflammatories, and good oral care.

Combination therapy with a kallikrein inhibitor and another therapeutic agent may be provided in multiple different configurations. In situations where the kallikrein inhibitor is to be administered by intraarticular injection, the kallikrein inhibitor and the therapeutic agent may be co-administered as a single composition, or they may be administered by separate injections. In some situations, the kallikrein inhibitor and the therapeutic agent are administered in close temporal proximity (e.g., a short time interval between the injections, such as during the same treatment session), or more widely spaced, depending on the desired schedule of administration for the two components of the combination therapy. When the kallikrein inhibitor is to be administered by systemic (parenteral) administration, the kallikrein inhibitor and the therapeutic agent may be administered in close temporal proximity or more widely spaced, depending on the intended dosing schedule for the two components of the combination therapy. Administration The kallikrein inhibitor (alone or as part of a combination therapy) can be administered to a patient before, during, and/or after the onset clinical symptoms of mucositis. The patient is generally a human, but may also be a non-human mammal. Human patients include adults, e.g., patients between ages 19-25, 26-40, 41-55, 56-75, and 76 and older, and pediatric patients, e.g., patients between ages 0-2, 3-6, 7-12, and 13-18.

The term "pharmaceutically acceptable" composition refers to a non-toxic carrier or excipient that may be administered to a patient, together with a kallikrein inhibitor described herein. The carrier or excipient is chosen to be compatible with the biological or pharmacological activity of the composition. The kallikrein inhibitors (and, in the case of combination therapy, other therapeutic agent) described herein can be administered locally or systemically by any suitable means for delivery of an inhibitory amount of the inhibitor and/or other therapeutic agent to a patient including but not limited to systemic administrations such as, for example, intravenous and inhalation. Parenteral administration is particularly preferred for the kallikrein inhibitor.

For parenteral administration, the kallikrein inhibitor can be injected intravenously, intramuscularly, intraperitoneally, or subcutaneously. Subcutaneous injection and i.v. administration are preferred routes for parenteral administration. Also useful is local (intraarticular) injection.

Typically, compositions for administration by injection are solutions in sterile isotonic aqueous buffer (e.g., sodium/potassium phosphate buffered saline). Other pharmaceutically acceptable carriers include, but are not limited to, sterile water, saline solution, and buffered saline (including buffers like phosphate or acetate), alcohol, vegetable oils, polyethylene glycols, gelatin, lactose, amylose, magnesium stearate, talc, silicic acid, paraffin, etc. Where necessary, the composition can also include a solubilizing agent and a local anesthetic such as lidocaine to ease pain at the site of the injection, preservatives, stabilizers, wetting agents, emulsifiers, salts, lubricants, etc. as long as they do not react deleteriously with the active compounds. Similarly, the composition can comprise conventional excipients, e.g., pharmaceutically acceptable organic or inorganic carrier substances suitable for parenteral, enteral or intranasal application which do not deleteriously react with the active compounds. Generally, the ingredients will be supplied either separately or mixed together in unit dosage form, for example, as a dry lyophilized powder or water free concentrate in a hermetically sealed container such as an ampoule, sachette, or vial indicating the quantity of active agent in activity units. Where the composition is to be administered by infusion, it can be dispensed with an infusion bottle containing sterile pharmaceutical grade "water for injection" or saline. Where the composition is to be administered by injection, a container (e.g., ampoule or vial) of sterile water for injection or saline can be provided so that the ingredients can be mixed prior to administration.

Exemplary formulations for subcutaneous administration of an isolated kallikrein inhibitor include buffered solutions containing a buffering agent (e.g., histidine or phosphate buffer) and a cryoprotectant (e.g., sucrose or sucrose and mannitol, optionally including a dextran such as dextran 40), and may be lyophilized for storage and distribution as described in U.S. Pub. App. No. 2007-0213275 (U.S. Ser. No. 11/716,278, filed Mar. 9, 2007).

In one embodiment, the kallikrein inhibitor is administered to a patient as an intravenous infusion according to any approved procedure. In another embodiment, the kallikrein inhibitor is administered to a patient as a subcutaneous bolus. In another embodiment, the kallikrein inhibitor is administered to a patient by intraarticular injection. I.V. and intraarticular administration are typically carried out by a health care professional in a clinical setting (e.g., hospital, urgent care, or doctor's office), but subcutaneous injections may be self-administered or administered by a health care professional.

Parameters that can be evaluated for determining a dose of the kallikrein inhibitor for systemic administration, are described below with regards to DX-88 (a non-naturally occurring kallikrein inhibitor, SEQ ID NO:2). The total amount of circulating prekallikrein in plasma is reported to be approximately 500 nM to 600 nM (Silverberg et al., "The Contact System and Its Disorders," in Blood: Principles and Practice of Hematology, Handin, R. et al., eds, J B Lippincott Co., Philadelphia, 1995). If all prekallikrein is activated, about 520 nmoles/L of DX-88 (DX88) can be used to inhibit kallikrein in a stoichiometric manner. An individual having 5 L of plasma would require a dose of 2.6 micromoles DX-88, or approximately 18 mg based on the molecular weight of DX-88 of 7,054 Daltons. This was calculated as follows: the $K_i$ of DX88 is 0.044 nM. When it is desired to have a concentration of plasma kallikrein (PK) of, e.g., 1 nM, the formula $K_i$=0.044 nM=[DX88]×[PK]/[DX88–PK]=[DX88]×1 nm/499 nM, indicates that the concentration of free DX-88 is 22.0 nM. Thus, the total amount of DX-88 needed would be 499+22 or 521 nM. The dose can be reduced proportionally if not all of the prekallikrein is activated or if a portion of the kallikrein is deactivated by an endogenous inhibitor, e.g., C1 esterase inhibitor (C1INH). Thus, in certain embodiments, about 5, 10, 15, 20, 30, 40, 60, 80, 120, 250, 500, 600, 700, 800, 1000 mg of DX-88 can be administered to a subject, in a single dose or in one or more doses spread over a twenty-four hour period. Consideration of several other factors may provide a more accurate estimation of the dose of DX-88 required in practice, such as patient age, weight, and severity of the mucositis and associated symptoms.

In some embodiments, the kallikrein inhibitor polypeptide is administered in a dose of about 1-500 mg/m$^2$, preferably about 1-250 mg/m$^2$, 1-100 mg/m$^2$.

Devices and Kits

Pharmaceutical compositions that include the kallikrein inhibitor can be administered with a medical device. The device can designed with features such as portability, room temperature storage, and ease of use so that it can be used in settings outside of a hospital or emergency room/urgent care facility (e.g., by the patient or a caregiver in the home or in a doctor's office). The device can include, e.g., one or more housings for storing pharmaceutical preparations that include an isolated kallikrein inhibitor, and can be configured to deliver one or more unit doses of the agent or agents.

I.V. administration may be by bolus or infusion, using appropriate injection or infusion devices (e.g., catheters, infusion pumps, implants, and the like). Subcutaneous injection may be as an infusion, for example using a catheter and infusion pump or implantable device. Many other devices, implants, delivery systems, and modules are also known.

When the kallikrein inhibitor is distributed as a lyophilized powder, it must be reconstituted prior to use. Manual reconstitution (e.g., manual addition of diluent to the lyophilized formulation by injection through an injection port into the container containing the lyophilized formulation) may be used, or the kallikrein inhibitor may be provided in a device configured for automatic reconstitution (e.g., automatic addition of the diluent to the lyophilized formulation), such as the BECTON-DICKINSON BD™ Liquid Dry Injector.

The isolated kallikrein inhibitor can be provided in a kit. In one embodiment, the kit includes (a) a container that contains a composition that includes an isolated kallikrein inhibitor, and (b) informational material that relates to the methods described herein and/or the use of the agents for therapeutic benefit.

In certain embodiments, the kit includes also includes another therapeutic agent. For example, the kit includes a first container that contains a composition that includes the isolated kallikrein inhibitor, and a second container that includes the other therapeutic agent. The isolated kallikrein inhibitor and the other therapeutic agent may be supplied in the same container for use in methods in which the kallikrein inhibitor and the therapeutic agent are administered as a single composition.

The informational material of the kits is not limited in its form. In one embodiment, the informational material can include information about production of the compound, molecular weight of the compound, concentration, date of expiration, batch or production site information, and so forth. In one embodiment, the informational material relates to methods of administering the isolated kallikrein inhibitor, e.g., in a suitable dose, dosage form, or mode of administration (e.g., a dose, dosage form, or mode of administration described herein), to treat a subject who has mucositis. The information can be provided in a variety of formats, include printed text, computer readable material, video recording, or audio recording, or a information that provides a link or address to substantive material.

In addition to the isolated kallikrein inhibitor (and, if present, the additional therapeutic agent(s)), the composition in the kit can include other ingredients, such as a solvent or buffer, a stabilizer, or a preservative. The isolated kallikrein inhibitor (and other therapeutic agent, if present) can be provided in any form, e.g., liquid, dried or lyophilized form, preferably substantially pure and/or sterile. When the agents are provided in a liquid solution, the liquid solution preferably is an aqueous solution. When the agents are provided as a dried form, reconstitution generally is by the addition of a suitable solvent. The solvent, e.g., sterile water or buffer, can optionally be provided in the kit.

The kit can include one or more containers for the composition or compositions containing the agents. In some embodiments, the kit contains separate containers, dividers or compartments for the composition and informational material. For example, the composition can be contained in a bottle, vial, or syringe, and the informational material can be contained in a plastic sleeve or packet. In other embodiments, the separate elements of the kit are contained within a single, undivided container. For example, the composition is contained in a bottle, vial or syringe that has attached thereto the informational material in the form of a label. In some embodiments, the kit includes a plurality (e.g., a pack) of individual containers, each containing one or more unit dosage forms (e.g., a dosage form described herein) of the agents. The containers can include a combination unit dosage, e.g., a unit that includes both the isolated kallikrein inhibitor and another therapeutic agent, e.g., in a desired ratio. For example, the kit includes a plurality of syringes, ampoules, foil packets, blister packs, or medical devices, e.g., each containing a single combination unit dose. The containers of the kits can be air tight, waterproof (e.g., impermeable to changes in moisture or evaporation), and/or light-tight.

The kit optionally includes a device suitable for administration of the composition, e.g., a syringe or other suitable delivery device. The device can be provided pre-loaded with one or both of the agents or can be empty, but suitable for loading.

Exemplification

The following examples provide further illustration and are not limiting.

Prophetic Example 1

Determination of the Efficacy of DX-88 for the Prevention and Treatment of Oral Mucositis The primary objective of this preclinical development plan is to establish the efficacy of an optimal formulation and schedule of DX-88 (and/or related compounds) as an intervention for oral mucositis induced by chemotherapy or radiation therapy used for the treatment of cancer. The plan consists of a series of logically sequenced experiments to be performed in a validated and predictive animal model (described below) of the condition:

Efficacy Screening (Step 1).

Acute radiation-induced mucositis is used to screen compounds and formulations. In this model, animals receive a single large dose of radiation directed to isolated cheek mucosa. The kinetics and extent of ulcerative mucositis that develops follows a consistent course. Attenuation of ulcerative mucositis is a robust endpoint that will be used to define DX-88 efficacy. Using this model, subcutaneous, intraperitoneal and topical formulations of DX-88 will be evaluated in a dose-ranging format.

Dose-Ranging Optimization and Schedule Screen (Step 2).

The lead formulation established in Step 1 will be evaluated using additional doses applied at varied scheduling schemes (i.e. pre-radiation and continuing for 7 days, post-radiation and daily for 14 days, etc).

Clinical Decision Point:

Determination of product target population (cycled chemotherapy, radiation therapy, HSCT). Subsequent pre-clinical testing modeled around anticipated product claims/market priorities.

Dose Scheduling Determination (Step 3).

If radiation therapy-induced mucositis is the lead indication, scheduling studies will be performed in a fractionated radiation model, which mimics the dosing schedule in humans. If, on the other hand, cycled chemotherapy is selected as the primary indication, a chemotherapy (likely 5-fluorouracil) model will be used. A smaller version of this study, focusing on the optimal protocol, may be done to confirm the observations of the original study.

Note: A requirement of any supportive oncology product is that it its protection of normal tissue does not modify tumor response to cytotoxic therapy. Consequently, in parallel, studies will be performed to demonstrate the inertia of DX-88 as a modifier of tumor growth or response to therapy.

Study 1. Mucositis Acute Radiation.

This will be a dose-ranging study comparing 2-3 formulations. This will be a 30 day study with 8 groups (64 animals). The dosing will be done from day −1 to day 20. If we observe efficacy in one or more treatment groups, we will be able to move directly to an optimization study. If there is no efficacy, we may have to repeat the study with increased dosing or altered formulations.

Study 2. Mucositis Acute Radiation.

This will be a dose-ranging study of the optimal formulation. In this study we will extend dose ranging and examine alternate dosing schedules. This will be a 30 day study with 8 groups (64 animals). If both studies go well and we determine an optimal dose/schedule protocol, we will move to a modified study to address specific clinical populations. It is possible that all questions of dose and schedule may not be answered in the first 2 studies. In that case, a third study may be necessary.

Study 3. Mucositis Acute Radiation (Necessity Dependent on Results of Studies 1+2).

Any ambiguous questions about optimal dose, formulation and/or schedule remaining after the first 2 studies will be addressed in this experiment. This will be a 30 day study with 8 groups (64 animals). This study may be larger or smaller depending on the questions that remain to be answered.

Study 4. Mucositis Study Targeted to a Clinical Population.

This study will be either a fractionated radiation study or a combination chemotherapy/radiation study depending on Dyax's development priority. This study objective will be to determine optimal dose and schedule for the specified clinical indication. In this study we will bracket the optimal doses and schedules to obtain best fit. A chemo/radiation study would take 40 days and evaluate 7 experimental groups (70 animals). The fractionated radiation study would also take 40 days to complete, would be of similar size.

Study 5. Mucositis Study Targeted to a Clinical Population.

This study will be a confirmatory study of Study 4. This study objective will be to confirm the optimal dose and schedule for the specified clinical indication. In this study we will bracket the optimal doses and schedules to obtain best fit. This study will be smaller than study 4 and will be priced according to the number on animals involved.

Prophetic Example 2

Determination of the Efficacy of Epi-KAL2 for the Prevention and Treatment of Oral Mucositis Study Objective The objective of this study is to demonstrate efficacy for EPI-KAL2 on the frequency, severity and duration of oral mucositis induced by acute radiation. EPI-KAL2 is potent ($K_{i,app}$=0.1 nM) active site inhibitor of pKal and a Kunitz domain inhibitor based on the first domain of tissue factor pathway inhibitor (Markland (1996) *Iterative optimization of high-affinity protease inhibitors using phage display. 2. Plasma kallikrein and thrombin. Biochemistry.* 35 (24):8058-67).

The sequence of EPI-KAL2 is:

(SEQ ID NO: 61)
EAMHSFCAFK*ADDGPCRAAHPRW*FFNIFTRQC*EEFSYGGCGGNQ*NRFESL

EECKKMCTRD (amino acids in italics are those that differ from TFPI)

In this initial study, 2 routes of administration will be studied. The primary goal of this study is to obtain a signal for efficacy for each route of administration. The results of this study will provide the basis for future optimization of both dose and schedule in the treatment of oral mucositis.

Materials and Methods

TABLE 2

| Test System | |
|---|---|
| Species/strain: | Golden Syrian Hamster |
| Physiological state: | Normal |
| Age/weight range at start of study: | Animals aged 5 to 6 weeks with body weight of approximately 80 g |
| Animal supplier: | Charles River Laboratories |
| Number/sex of animals: | 24/male |
| Identification: | Animals will be individually numbered using an ear punch. A cage card or label with the appropriate information necessary to identify the study, dose, animal number and treatment group will mark all cages. |
| Randomization: | Animals will be randomly and prospectively divided into 3 groups of 8 animals each prior to treatment or irradiation. |
| Justification: | The acute radiation model in hamsters has proven to be an accurate, efficient and cost-effective technique to provide a preliminary evaluation of anti-mucositis compounds. The model is also useful in studying specific mechanistic elements in the pathogenesis of mucositis and its prevention. |
| Replacement: | Animals will not be replaced during the course of the study. |

TABLE 3

| Test Article | |
|---|---|
| Identification (Lot Number) | EPI-KAL2 (Lot 100808) |
| Physical Description | Frozen liquid |
| Formulation | Phosphate buffered saline, pH 7.0 |
| Storage Conditions | Nominally −20° C. |
| Concentration | 5.6 mg/mL |
| Stability | Stable for 24 hours at 2-4° C. |
| Disposition of unused dosing mixture: | Unused, frozen test article will be returned to Sponsor. Empty and partially used vials of dosing preparations will be discarded according to proper disposal procedures. |

TABLE 4

| Administration of Test Article | |
|---|---|
| Route and method of administration: | Topically to left cheek pouch or IP |
| Justification for route of administration: | Topical and IP routes of exposure were selected because they represent potential routes of human exposure |
| Frequency and duration of dosing: | Animals will be dosed by both routes of administration on Days −1 to 20. Topical administration will be twice daily (BID) and IP administration will be once daily (QD). |
| Administered doses: | 20 mg/kg/day |
| Administered volume(s): | To be calculated based on pre-dosing body weight |
| Justification for dose levels: | The dose levels represent the upper dose range and were selected in an attempt to maximize potential efficacy |

Experimental Design

Twenty four (24) male Syrian Golden Hamsters will be given an acute radiation dose of 40 Gy directed to their left buccal cheek pouch on Day 0. This will be accomplished by anesthetizing the animals and everting the left buccal pouch, while protecting the rest of the animals with a lead shield. Test materials will be given by topical administration directed to the left cheek pouch, or IP injection. Mucositis will be evaluated clinically starting on Day 6, and continuing on alternate days until Day 28.

On Day 28, all animals will be euthanized by CO2 inhalation and death will be confirmed by monitoring heartbeat in accordance with USDA guidelines. At necropsy, left and right cheek pouches will be harvested and snap frozen in liquid nitrogen. These samples will be stored at −80° C. and shipped on dry ice for Biomarker analysis.

TABLE 5

Study Design

| Group Number | Number of Animals | Treatment | Route of Administration | Treatment Schedule* | Volume (mL) |
|---|---|---|---|---|---|
| 1 | 8 males | No Treatment | | None | N/A |
| 2 | 8 males | EPI-KAL2 20 mg/kg, bid | topical | Days −1 to 20 | Based on weight |
| 3 | 8 males | EPI-KAL2 20 mg/kg, qd | IP | Days −1 to 20 | Based on weight |

Experimental Procedures

Mucositis Induction

Mucositis will be induced using a single dose of radiation (40 Gy/dose) administered to all animals on Day 0. Radiation will be generated with a 160 kilovolt potential (15-ma) source at a focal distance of 21 cm, hardened with a 3.0 mm Al filtration system. Irradiation will target the left buccal pouch mucosa at a rate of 2.5 Gy/minute. Prior to irradiation, animals will be anesthetized with an intraperitoneal injection of ketamine (160 mg/kg) and xylazine (8 mg/kg). The left buccal pouch will be everted, fixed and isolated using a lead shield.

Mucositis Scoring

Starting on Day 6 and continuing every second day thereafter (Days 8, 10, 12, 14, 16, 18, 20, 22, 24, 26, & 28), each animal will be photographed and evaluated for mucositis scoring. Parameters to be measured include the mucositis score, weight change and survival. For the evaluation of mucositis, the animals will be anesthetized with inhalation anesthetics, and the left pouch everted. Mucositis will be scored visually by comparison to a validated photographic scale, ranging from 0 for normal, to 5 for severe ulceration (clinical scoring). In descriptive terms, this scale is defined as follows:

Score: Description:

0 Pouch completely healthy. No erythema or vasodilation.

1 Light to severe erythema and vasodilation. No erosion of mucosa.

2 Severe erythema and vasodilation. Erosion of superficial aspects of mucosa leaving denuded areas. Decreased stippling of mucosa.

3 Formation of off-white ulcers in one or more places. Ulcers may have a yellow/gray appearance due to pseudomembrane. Cumulative size of ulcers should equal about ¼ of the pouch. Severe erythema and vasodilation.

4 Cumulative size of ulcers should equal about ½ of the pouch. Loss of pliability. Severe erythema and vasodilation.

5 Virtually all of pouch is ulcerated. Loss of pliability (pouch can only partially be extracted from mouth)

A score of 1-2 is considered to represent a mild stage of the disease, whereas a score of 3-5 is considered to indicate moderate to severe mucositis. Following this preliminary clinical scoring, a photograph will be taken of each animal's mucosa using a standardized technique. At the conclusion of the experiment, film will be developed and the photographs randomly numbered for blinded scoring. Thereafter, two independent, trained observers will grade the photographs in blinded fashion using the above-described scale. For each photograph the actual blinded score will be based upon the average of the evaluator's scores. Only the scores from this blinded, photographic evaluation will be statistically analyzed and reported in the final study report.

Mucositis Evaluation

Using the blinded photographs, the grade of mucositis will be scored, beginning Day 6, and for every second day thereafter, through and including Day 28. The effect on mucositis of each drug treatment compared to vehicle control will be assessed according to the following parameters:

The difference in the number of days hamsters in each group have severe (score≥3) mucositis.

On each day the animals are scored (evaluation day), the number of animals with a blinded mucositis score of ≥3 in each drug treatment group will be compared to the vehicle control group. Differences will be analyzed on a daily as well as a cumulative basis. Treatment success will be considered if a statistically significant lower number of hamsters with a score of >3 in a drug treatment group, versus control as determined by chi-square analysis.

The rank sum differences in daily mucositis scores.

For each evaluation day the scores of the vehicle control group will be compared to those of the treated groups using the non-parametric rank sum analysis. Treatment success will be considered as a statistically significant lowering of scores in the treated group on 2 or more days from day 6 to day 28.

To evaluate the effect of test agents on mucositis resolution, the time to healing will be compared between test and controls. Resolution will be defined as the absence of ulcerative lesions (scores<3).

Body Weight

Every day for the period of the study, each animal will be weighed and its survival recorded, in order to assess possible differences in animal weight among treatment groups as an indication for mucositis severity and/or possible toxicity resulting from the treatments.

Animals Found Dead or Moribund

Animal deaths in this model generally occur as a consequence of anesthesia overdose or drug toxicity. Animals will be monitored on a daily basis and those exhibiting weight loss greater than 20% will be euthanized. Any adverse effects or unanticipated deaths will be reported immediately.

Data Analysis and Reporting

Statistical Analysis Statistical differences between treatment groups will be determined using Student's t-test, Mann-Whitney U test and chi-square analysis with a critical value of 0.05. It is anticipated that up to 10% animal death may occur, primarily as a result of the administration of anesthetics. However, the number of animals expected to remain alive at Day 28 (6 per treatment group) is considered acceptable for statistical evaluation.

Example 3

Inhibitory Anti-Plasma Kallikrein Binding Proteins

We have discovered several antibody inhibitors and binders of plasma kallikrein (pKal). The most potent of these have been further characterized and shown to have apparent inhibition constants ($K_{i,app}$)<10 nM, to be specific pKal inhibitors with respect to other tested serine proteases, and to not bind prekallikrein. Amino acid sequences of the CDRs for the inhibitors are shown in Table 6.

TABLE 6

CDR Amino Acid Sequences, ELISA Signal, and Apparent Inhibition Constant of Antibody Inhibitors of PKal

| Initial Name | Human pKal ELISA (T/B) | Human pKal (Ki,app nM) | LV-CDR1 (SEQ ID NOS 62-98, respectively, in order of appearance) | LV-CDR2 (SEQ ID NOS 99-135, respectively, in order of appearance) | LV-CDR3 (SEQ ID NOS 135-172, respectively, in order of appearance) | HV-CDR1 (SEQ ID NOS 173-209 respectively, in order of appearance) | HV-CDR2 (SEQ ID NOS 210-246, respectively, in order of appearance) | HV-CDR3 (SEQ ID NOS 247-283, respectively, in order of appearance) |
|---|---|---|---|---|---|---|---|---|
| M6-D09 | 39.9 | 5.9 | RASQSIRNYLN | AASTLQS | QQLSGYPHT | FYYMV | VIYPSGGITVYADSVKG | DKWAVMPPYYYYAMDV |
| M7-B04 | 4.1 | 54 | TGTNSDVGNYNLVS | EVNKRPS | CSYAGNRNFYV | WYSMV | SISPSGGLTNYADSVKG | HTAARPFYYYYMDV |
| M7-E07 | 45.7 | 36 | SGDKLGDKYAC | QDSKRPS | QAWDSSTGV | WYLMI | YIYPSGGFTYYADSVKG | TEGPLSWGYGMDV |
| M8-A09 | 5.4 | 105 | SGDKLGNKYAY | QDNNRPS | QAWDSRTVV | TYFML | SIYPSGGNTVYADSVKG | AASPVRNYYYYGMDV |
| M10-F10 | 39.2 | <100 nM | RASQSISVYLN | GASNLQF | QQTFSLFT | FYNMN | SISPSGGETNYADSVKG | GGGAYRNNWWGGFDI |
| M10-H05 | 42.2 | 18 | RASQSVSSSYLA | GASSRAT | QQYGSSPFT | PYNMY | SIRPSGGGTVYADSVKG | GFIAARWYYFDY |
| M12-B05 | 38.4 | 4.9 | SGNKLGDKYVA | QDTKRPS | QAWDSSIVI | WYTMV | YIYPSGGATFYADSVKG | GSYDYIWGFYSDH |
| M12-D05 | 48.5 | 5.2 | SGDQLGDKYVG | QDTKRPS | QAWDTSTAG | WYTMV | RIYPSGGWTKYADSVKG | EGLLWFGENAFDI |
| M27-E05 | 41.3 | 16 | SGDKLGDKYAC | QDSKRPS | QAWDSSTGV | WYLMI | YIYPSGGFTYYADSVKG | TEGPLSWGYGMDV |
| M28-B11 | 33.3 | 5.5 | SGDQLGDKYVG | QDTKRPS | QAWDTSTAG | WYTMV | RIYPSGGWTKYADSVKG | EGLLWFGENAFDI |
| M29-D09 | 47.5 | 0.7 | SGNKLGDKYVA | QDTKRPS | QAWDSSIVI | WYTMV | YIYPSGGATFYADSVKG | GSYDYIWGFYSDH |
| M29-E09 | 28.8 | 11 | SGDNLGNKYNS | QDTKRPS | QAWDGNVV | WYEMG | SIYSSGGGTMYADSVKG | NPQYSGYDRSLSDGAFDI |
| M35-G04 | 11.1 | 2.9 | RASQSVSSYLA | DASNRAT | QQRSNWPRGFT | YYHMS | VISPSGGSTKYADSVKG | GGSSDYAWGSYRRPYYFDY |
| M38-F02 | 33.5 | 14 | SGEKLGDKYVS | EDSRRPS | QAWDSSTAI | YYMMV | YIYSSGGHTVYADSVKG | DLFLYDFWSKGAFDI |
| M41-A11 | 28.0 | 13 | SGDKLGDKYTS | QDIKRPS | QAWDSPNARV | HYRMS | SIYPSGGRTVYADSVKG | DKFEWRLLFRGIGNDAFDI |
| M73-D06 | 4.0 | <100 nM | SGSSSNIGSNTVS | NDHRRPS | SAWDDSLNGVV | RYEMY | SISSSGGPTAYADSVKG | GTPKWELLLRSIYIENAFDI |
| M76-D01 | 11.2 | <100 nM | RSSQSLSDDGNTYLD | TLSYRAS | MQGTHWPPT | FYAMH | GIVPSGGRTHYADSVKG | DSSGSPNPLFDY |
| M110-C12 | 2.4 | <100 nM | RSSLSLLHSNGYNYLD | LSSTRAS | MQPLETPPT | YYEMD | GISSSGGHTAYADSVKG | ERRSSSRARYYYGMDV |

TABLE 6-continued

CDR Amino Acid Sequences, ELISA Signal, and Apparent Inhibition
Constant of Antibody Inhibitors of PKal

| Initial Name | Human pKal ELISA (T/B) | Human pKal (Ki, app nM) | LV-CDR1 (SEQ ID NOS 62-98, respectively, in order of appearance) | LV-CDR2 (SEQ ID NOS 99-135, respectively, in order of appearance) | LV-CDR3 (SEQ ID NOS 135-172, respectively, in order of appearance) | HV-CDR1 (SEQ ID NOS 173-209, respectively, in order of appearance) | HV-CDR2 (SEQ ID NOS 210-246, respectively, in order of appearance) | HV-CDR3 (SEQ ID NOS 247-283, respectively, in order of appearance) |
|---|---|---|---|---|---|---|---|---|
| M137-E12 | 4.5 | 79 | SGNNSNFGSNTVT | SDSRRPS | AAWDDSLNGV | DYRMQ | VIVPSGGNTMYADSVKG | GGPGSSIAARPAPTGYYGMDV |
| M142-H08 | 29.9 | 0.2 | RASQPIDNYLN | AASRLQS | QQSYTVPYT | AYSMI | YIRPSGGRTTYADSVKG | GGLLLWFRELKSNYFDY |
| M145-D01 | 6.2 | 1.1 | RASQSVSSYLA | DASNRAT | QQRSNWPRGFT | YYHMS | VISPSGGSTKYADSVKG | GGSSDYAWGSYRRPYYFDY |
| M145-D11 | 40.0 | 0.79 | SGDKLGDKYTS | QDIKRPS | QAWDSPNARV | HYRMS | SIYPSGGRTVYADSVKG | DKFEWRLLERGIGNDAFDI |
| M146-E12 | 40.6 | 2.2 | RASGDIGNALG | DASTLQS | LQGYNYPRT | RYIMH | SISPSGGLTSYADSVKG | EFENAYHYYYYGMDV |
| M152-A12 | 19. | <100 nM | RASQSISSYLS | AASSLQS | QQSISIPRT | PYFMG | GIGPSGGSTTYADSVKG | EGPPYSSGWYRGLRQYHFDY |
| M160-G12 | 38.3 | 17 | RASQGISSYLA | AASTLQS | QQLNSYPLT | HYLMT | YISPSGGHTIYADSVKG | VARGIAARSRTSYFDY |
| M161-C11 | 41.8 | 0.3 | SGDKLGDKYVS | QDTKRPS | QAWDSSTYV | DYAMK | SISSSGGVTQYADSVKG | EEDYSSSWYSRRFDYYYGMDV |
| M162-A04 | 11.4 | 4.8 | RASQSISSWLA | KASTLES | QQYNTYWT | HYIMM | GIYSSGGITVYADSVKG | RRTGIPRRDAFDI |
| X67-B03 | nd | 2.1 | RASQPIDNYLN | AASRLQS | QQSYTVPYT | AYSMI | YIRPSGGRTTYADSVKG | GGLLLWSRELKSNYFDY |
| X67-C03 | nd | 0.7 | RASQPIDNYLN | AASRLQS | QQSYTVPYT | AYSMI | YIRPSGGRTTYADSVKG | GGLLLWFMELKSNYFDY |
| X67-C09 | nd | 8.6 | RASQPIDNYLN | AASRLQS | QQSYTVPYT | AYSMI | YIRPSGGRTTYADSVKG | GGLLLWGRELKSNYFDY |
| X67-D03 | nd | 0.1 | RASQPIDNYLN | AASRLQS | QQSYTVPYT | AYSMI | YIRPSGGRTTYADSVKG | GGLLLWNRELKSNYFDY |
| X67-E04 | nd | 1.3 | RASQPIDNYLN | AASRLQS | QQSYTVPYT | AYSMI | YIRPSGGRTTYADSVKG | GGLLLWDRELKSNYFDY |
| X67-F01 | nd | 0.9 | RASQPIDNYLN | AASRLQS | QQSYTVPYT | AYSMI | YIRPSGGRTTYADSVKG | GGLLLWQRELKSNYFDY |
| X67-F10 | nd | 1.3 | RASQPIDNYLN | AASRLQS | QQSYTVPYT | AYSMI | YIRPSGGRTTYADSVKG | GGLLLWTRELKSNYFDY |
| X67-G04 | nd | 0.35 | RASQPIDNYLN | AASRLQS | QQSYTVPYT | AYSMI | YIRPSGGRTTYADSVKG | GGLLLWARELKSNYFDY |
| X67-H04 | nd | 3.6 | RASQPIDNYLN | AASRLQS | QQSYTVPYT | AYSMI | YIRPSGGRTTYADSVKG | GGLLLWERELKSNYFDY |
| X81-B01 | nd | 0.2 | RTSQEVNSNYLA | GASSRAT | QQSSRTPWT | HYLMT | YISPSGGHTIYADSVKG | VARGIAARSRTSYFDY |

Abbreviations used:
"T/B" is the ELISA signal obtained using of the "target" (biotinylated plasma kallikrein) divided by the ELISA signal of the "background" (streptavidin); both of which were coated on microtiter plates.
"nd" is not determined.
The symbol "q" refers to the amber suppressible stop codon (TAG), which is translated as glutamine (Q) in strains of E. coli such as the TG1 cells that were used to express the Fab fragments.

Amino acid sequences of light chain (LC) and heavy chain (HC) variable domain of pKal antibody inhibitors are shown below.

```
M6-D09 LC (SEQ ID NO: 284)
QDIQMTQSPS SLSASVSDRV TITCRASQSI RNYLNWYQQK PSKAPNLLIY AASTLQSGVP   60
ARFSGSGSGT DFTLTISSLQ PEDFATYYCQ QLSGYPHTFG QGTKLEIK              108

M6-D09 HC (SEQ ID NO: 285)
EVQLLESGGG LVQPGGSLRL SCAASGFTFS FYYMVWVRQA PGKGLEWVSV IYPSGGITVY   60
ADSVKGRFTI SRDNSKNTLY LQMNSLRAED TAVYYCARDK WAVMPPYYYY AMDVWGQGTT  120
VTVSSASTKG PSVFPLAPSS KS                                          142

M7-B04 LC (SEQ ID NO: 286)
QSALTQPASV SGSPGQSITI SCTGTNSDVG NYNLVSWYQQ HPGEAPKLLI YEVNKRPSGV   60
SNRFSGSKSG NTASLTISGL QAEDEADYLC CSYAGNRNFY VFGAGTKVTV L           111

M7-B04 HC (SEQ ID NO: 287)
EVQLLESGGG LVQPGGSLRL SCAASGFTFS WYSMVWVRQA PGKGLEWVSS ISPSGGLTNY   60
ADSVKGRFTI SRDNSKNTLY LQMNSLRAED TAVYYCARHT AARPFYYYYM DVWSKSTTVT  120
VSSASTKGPS VFPLAPSSKS                                             140

M7-E07 LC (SEQ ID NO: 288)
QSELTQPPSV SVSPGQTASI TCSGDKLGDK YACWYQQKPG QSPVLVIYQD SKRPSGIPER   60
FSGSNSGNTA TLTISGTQAM DEADYYCQAW DSSTGVFGGG TKLTVL                106

M7-E07 HC (SEQ ID NO: 289)
EVQLLESGGG LVQPGGSLRL SCAASGFTFS WYLMIWVRQA PGKGLEWVSY IYPSGGFTYY   60
ADSVKGRFTI SRDNSKNTLY LQMNSLRAED MAVYYCARTE GPLSWGYGMD VWGQGTTVTV  120
SSASTKGPSV FPLAPSSKS                                              139

M8-A09 LC (SEQ ID NO: 290)
QCELTQPPSE SVSPGQTANI TCSGDKLGNK YAYWYQQKPG QSPVLVIYQD NNRPSGIPER   60
FSGSNSGNTA TLTISGTQAI DEANYYCQAW DSRTVVFGGG TKLTVL                106

M8-A09 HC (SEQ ID NO: 291)
EVQLLESGGG LVQPGGSLRL SCAASGFTFS TYFMLWVRQA PGKGLEWVSS IYPSGGNTVY   60
ADSVKGRFTI SRDNSKNTLY LQMNSLRAED TAVYYCARAA SPVRNYYYYG MDVWGQGTTV  120
TVSSASTGP SVFPLAPSSK S                                            141

M10-F10 LC (SEQ ID NO: 292)
QDIQMTQSPS SLSASVGDRV TITCRASQSI SVYLNWYQHK PGKAPKLLIY GASNLQFGVP   60
SRFSGSGYGT DFTLTISSLQ PEDFATYHCQ QTFSLFTFGG GTKVEIK               107

M10-F10 HC (SEQ ID NO: 293)
EVQLLESGGG LVQPGGSLRL SCAASGFTFS FYNMNWVRQA PGKSLEWVSS ISPSGGETNY   60
ADSVKGRFTI SRDNSKNTLY LQMNSLRAED TAVYYCARGG GAYRNNWWGG FDIWGLGTMV  120
TVSSASTKGP SVFPLAPSSK S                                           141

M10-H05 LC (SEQ ID NO: 294)
QDIQMTQSPG TLSLSPGERA TLSCRASQSV SSSYLAWYQQ KPGQAPRLLI YGASSRATGI   60
PDRFSGSGSG TDFTLTISRL EPEDFAVYYC QQYGSSPFTF GPGTKVDIK             109

M10-H05 HC (SEQ ID NO: 295)
EVQLLESGGG LVQPGGSLRL SCAASGFTFS PYNMYWVRQA PGKGLEWVSS IRPSGGGTVY   60
ADSVKGRFTI SRDNSKNTLY LQMNSLRAED TAVYYCAGGF IAARWYYFDY WGQGTLVTVS  120
SASTKGPSVF PLAPSSKS                                               138

M12-B05 LC (SEQ ID NO: 296)
QSALTQPPTV SVSPGQTARI TCSGNKLGDK YVAWYQQKPG QSPMLVIYQD TKRPSRVSER   60
FSGSNSANTA TLSISGTQAL DEADYYCQAW DSSIVIFGGG TRLTVL                106

M12-B05 HC (SEQ ID NO: 297)
EVQLLESGGG LVQPGGSLRL SCAASGFTFS WYTMVWVRQA PGKGLEWVSY IYPSGGATFY   60
ADSVKGRFTI SRDNSKNTLY LQMNSLRAED TAVYYCAMGS YDYIWGFYSD HWGQGTLVTV  120
SSASTKGPSV FPLAPSSKS                                              139

M12-D05 LC (SEQ ID NO: 298)
QSVLTQPPSV SVSPGQTATI TCSGDQLGDK YVGWYQQKPG QSPILVIYQD TKRPSGIPER   60
FSGSNSGNTA TLTISGTHTV DEAHYYCQAW DTSTAGFGGG TKLTVL                106

M12-D05 LC (SEQ ID NO: 299)
EVQLLESGGG LVQPGGSLRL SCAASGFTFS WYTMVWVRQA PGKGLEWVSR IYPSGGWTKY   60
ADSVKGRFTI SRDNSKNTLY LQMNSLRAED TATYYCAREG LLWFGENAFD IWGQGTMVTV  120
SSASTKGPSV FPLAPSSKS                                              139

M27-E05 LC (SEQ ID NO: 300)
QSELTQPPSV SVSPGQTASI TCSGDKLGDK YACWYQQKPG QSPVLVIYQD SKRPSGIPER   60
FSGSNSGNTA TLTISGTQAM DEADYYCQAW DSSTGVFGGG TKLTVL                106
```

```
M27-E05 HC  (SEQ ID NO: 301)
EVQLLESGGG LVQPGGSLRL SCAASGFTFS WYLMIWVRQA PGKGLEWVSY IYPSGGFTYY   60
ADSVKGRFTI SRDNSKNTLY LQMNSLRAED MAVYYCARTE GPLSWGYGMD VWGQGTTVTV  120
SSASTKGPSV FPLAPSSKS                                              139

M28-B11 LC  (SEQ ID NO: 302)
QSVLTQPPSV SVSPGQTATI TCSGDQLGDK YVGWYQQKPG QSPILVIYQD TKRPSGIPER   60
FSGSNSGNTA TLTISGTHTV DEAHYYCQAW DTSTAGFGGG TKLTVL                 106

M28-B11 HC  (SEQ ID NO: 303)
EVQLLESGGG LVQPGGSLRL SCAASGFTFS WYTMVWVRQA PGKGLEWVSR IYPSGGWTKY   60
ADSVKGRFTI SRDNSKNTLY LQMNSLRAED TATYYCAREG LLWFGENAFD IWGQGTMVTV  120
SSASTKGPSV FPLAPSSKS                                              139

M29-D09 LC  (SEQ ID NO: 304)
QSALTQPPTV SVSPGQTARI TCSGNKLGDK YVAWYQQKPG QSPMLVIYQD TKRPSAIPER   60
FSGSNSANTA TLSISGTQAL DEADYYCQAW DSSIVIFGGG TRLTVL                 106

M29-D09 LC  (SEQ ID NO: 305)
EVQLLESGGG LVQPGGSLRL SCAASGFTFS WYTMVWVRQA PGKGLEWVSY IYPSGGATFY   60
ADSVKGRFTI SRDNSKNTLY LQMNSLRAED TAVYYCAMGS YDYIWGFYSD HWGQGTLVTV  120
SSASTKGPSV FPLAPSSKS                                              139

M29-E09 LC  (SEQ ID NO: 306)
QYELTQPPSV SVSPSQTATI TCSGDNLGNK YNSWYQQKPG QSPLLVIYQD TKRPSAIPER   60
FSGSNSGNTA ILTISGTQAM DEADYYCQAW DGNVVFGGGT KLTVL                  105

M29-E09 HC  (SEQ ID NO: 307)
EVQLLESGGG LVQPGGSLRL SCAASGFTFS WYEMGWVRQA PGKGLEWVSS IYSSGGGTMY   60
ADSVKGRFTI SRDNSKNTLY LQMNSLRAED TAVYYCARNP QYSGYDRSLS DGAFDIWGQG  120
TMVTVSSAST KGPSVFPLAP SSKS                                        144

M35-G04 LC  (SEQ ID NO: 308)
QDIQMTQSPA TLSLSPGERA TLSCRASQSV SSYLAWYQQK PGQAPRLLIY DASNRATGIP   60
ARFSGSGSGT DFTLTISSLE PEDFAVYYCQ QRSNWPRGFT FGPGTKVDIK             110

M35-G04 HC  (SEQ ID NO: 309)
EVQLLESGGG LVQPGGSLRL SCAASGFTFS YYHMSWVRQA PGKGLEWVSV ISPSGGSTKY   60
ADSVKGRFTI SRDNSKNTLY LQMNSLRAED TAVYYCARGG SSDYAWGSYR RPYYFDYWGQ  120
GTLVTVSSAS TKGPSVFPLA PSSKS                                       145

M38-F02 LC  (SEQ ID NO: 310)
QSVLTQPPSV SVSPSQTASI TCSGEKLGDK YVSWYQQKPG QSPSLVICED SRRPSGIPER   60
FSGSNSGNTA TLTISGAQPM DEADYYCQAW DSSTAIFGPG TKVTVL                 106

M38-F02 HC  (SEQ ID NO: 311)
EVQLLESGGG LVQPGGSLRL SCAASGFTFS YYMMVWVRQA PGKGLEWVSY IYSSGGHTVY   60
ADSVKGRFTI SRDNSKNTLY LQMNSLRAED TAVYYCARDL FLYDFWSKGA FDIWGQGTMV  120
TVSSASTKGP SVFPLAPSSK S                                           141

M41-A11 LC  (SEQ ID NO: 312)
QSVLTQPPSV SVSPGQTASI TCSGDKLGDK YTSWYQQRPG QSPVLVIYQD IKRPSGIPER   60
FSGSNSGNTA TLTISGTQAM DEADYYCQAW DSPNARVFGS GTKVTVL                107

M41-A11 HC  (SEQ ID NO: 313)
EVQLLESGGG LVQPGGSLRL SCAASGFTFS HYRMSWVRQA PGKGLEWVSS IYPSGGRTVY   60
ADSVKGRFTI SRDNSKNTLY LQMNSLRAED TAVYYCAKDK FEWRLLFRGI GNDAFDIWGQ  120
GTMVTVSSAS TKGPSVFPLA PSSKS                                       145

M73-D06 LC  (SEQ ID NO: 314)
QSELTQPPSA SETPSQRVTI SCSGSSSNIG SNTVSWFQQL PGSAPRLLIY NDHRRPSGVP   60
DRFSGSKSGT SASLVISGLQ SQDEADYYCS AWDDSLNGVV FGGGTKLTVL             110

M73-D06 HC  (SEQ ID NO: 315)
EVQLLESGGG LVQPGGSLRL SCAASGFTFS RYEMYWVRQA PGKGLEWVSS ISSSGGPTAY   60
ADSVKGRFTI SRDNSKNTLY LQMNSLRAED TAMYYCAKGT PKWELLLRSI YIENAFDIWS  120
QGTMVTVSSA STKGPSVFPL APSSKS                                      146

M76-D01 LC  (SEQ ID NO: 316)
QDIVMTQTPP SLPVNPGEPA SISCRSSQSL SDDGNTYLDW YLQRPGQSPQ LLIHTLSYRA   60
SGVPDRFSGS GSGTDFTLKI SRVEAEDVGV YYCMQGTHWP PTFGQGTKVE IK          112

M76-D01 HC  (SEQ ID NO: 317)
EVQLLESGGG LVQPGGSLRL SCAASGFTFS FYAMHWVRQA PGKGLEWVSG IVPSGGRTHY   60
ADSVKSRFTI SRDNSKNTLY LQMNSLRAED TAVYYCATDS SGSPNPLFDY WGQGTLVTVS  120
SASTKGPSVF PLAPSPKS                                               138

M110-C12 LC  (SEQ ID NO: 318)
QDIQMTQSPL SLSVTPGEPA SISCRSSLSL LHSNGYNYLD WYVQRPGQSP QLLMYLSSTR   60
ASGVPDRFSG SGSGTDFTLE ISRVEAEDVG VYYCMQPLET PPTFGGGTKV EIK         113
```

```
M110-C12 HC (SEQ ID NO: 319)
EVQLLESGGG LVQPGGSLRL SCAASGFTFS YYEMDWVRQA PGKGLEWVSG ISSSGGHTAY    60
ADSVKGRFTI SRDNSKNTLY LQMNSLRAED TATYYCARER RSSSRARYYY GMDVWGQGTT   120
VTVSSASTKG PSVFPLAPSS KS                                            142

M137-E12 LC (SEQ ID NO: 320)
QSVLIQPPSV SGIPGQRVTI SCSGNNSNFG SNTVTWYQQL PGTAPKLLIY SDSRRPSGVP    60
DRFSGSRSDT SASLAISGLQ SEDEAEYHCA AWDDSLNGVF GGGTKLTVL               109

M137-E12 HC (SEQ ID NO: 321)
EVQLLESGGG LVQPGGSLRL SCAASGFTFS DYRMQWVRQA PGKGLEWVSV IVPSGGNTMY    60
ADSVKGRFTI SRDNSKNTLY LQMNSLRAED TAVYYCARGG PGSSIAARRA PTGYYGMDVW   120
GQGTTVTVSS ASTKGPSVFP LAPSSKS                                       147

M142-H08 LC (SEQ ID NO: 322)
QDIQMTQSPS SLSAFVGDRV TITCRASQPI DNYLNWYHQK PGKAPKLLIY AASRLQSGVP    60
SRLSGSGFGT DFTLTISSLQ PEDFGNYYCQ QSYTVPYTFG GGTKVEIR                108

M142-H08 HC (SEQ ID NO: 323)
EVQLLESGGG LVQPGGSLRL SCAASGFTFS AYSMIWVRQA PGKGLEWVSY IRPSGGRTTY    60
ADSVKGRFTI SRDNSKNTLY LQMNSLRAED TAVYYCARGG LLLWFRELKS NYFDYWGQGT   120
LVTVSSASTK GPSVFPLAPS SKS                                           143

M145-D01 LC (SEQ ID NO: 324)
QDIQMTQSPA TLSLSPGERA TLSCRASQSV SSYLAWYQQK PGQAPRLLIY DASNRATGIP    60
ARFSGSGSGT DFTLTISSLE PEDFAVYYCQ QRSNWPRGFT FGPGTKVDIK              110

M145-D01 HC (SEQ ID NO: 325)
EVQLLESGGG LVQPGGSLRL SCAASGFTFS YYHMSWVRQA PGKGLEWVSV ISPSGGSTKY    60
ADSVKGRFTI SRDNSKNTLY LQMNSLRAED TAVYYCARGG SSDYAWGSYR RPYYFDYWGQ   120
GTLVTVSSAS TKGPSVFPLA PSSKS                                         145

M145-D11 LC (SEQ ID NO: 326)
QSVLTQPPSV SVSPGQTASI TCSGDKLGDK YTSWYQQRPG QSPVLVIYQD IKRPSGIPER    60
FSGSNSGNTA TLTISGTQAM DEADYYCQAW DSPNARVFGS GTKVTVL                 107

M145-D11 HC (SEQ ID NO: 327)
EVQLLESGGG LVQPGGSLRL SCAASGFTFS HYRMSWVRQA PGKGLEWVSS IYPSGGRTVY    60
ADSVKGRFTI SRDNSKNTLY LQMNSLRAED TAVYYCAKDK FEWRLLFRGI GNDAFDIWGQ   120
GTMVTVSSAS TKGPSVFPLA PSSKS                                         145

M146-E12 LC (SEQ ID NO: 328)
QDIQMTQSPS SLSASVGDRV TITCRASGDI GNALGWYQQK PGKAPRLLIS DASTLQSGVP    60
LRFSGSGSGT EFTLTISSLQ PEDFATYYCL QGYNYPRTFG QGTKLEIR                108

M146-E12 HC (SEQ ID NO: 329)
EVQLLESGGG LVQPGGSLRL SCAASGFTFS RYIMHWVRQA PGKGLEWVSS ISPSGGLTSY    60
ADSVKGRFTI SRDNSKNTLY LQMNSLRAED TAVYYCAREF ENAYHYYYG MDVWGQGTTV   120
TVSSASTKGP SVFPLAPSSK S                                             141

M152-A12 LC (SEQ ID NO: 330)
QDIQMTQSPS SLSASVGDRV TITCRASQSI SSYLSWYQQR PGKAPNLLIY AASSLQSGVP    60
SRFSGSGSGT DFTLTISSLQ PEDFATYYCQ QSISIPRTFG QGTKVEVK                108

M152-A12 HC (SEQ ID NO: 331)
EVQLLESGGG LVQPGGSLRL SCAASGFTFS PYFMGWVRQA PGKGLEWVSG IGPSGGSTTY    60
ADSVKGRFTI SRDNSKNTLY LQMNSLRAED TAVYYCAREG PPYSSGWYRG LRQYHFDYWG   120
QGTLVTVSSA STKGPSVFPL APSSKS                                        146

M160-G12 LC (SEQ ID NO: 332)
QDIQMTQSPS FLSASVGDRV TITCRASQGI SSYLAWYQQK PGKAPKLLIY AASTLQSGVP    60
SRFSGSGSGT EFTLTISSLQ PEDFATYYCQ QLNSYPLTFG GGTKVEIK                108

M160-G12 HC (SEQ ID NO: 333)
EVQLLESGGG LVQPGGSLRL SCAASGFTFS HYLMTWVRQA PGKGLEWVSY ISPSGGHTIY    60
ADSVKGRFTI SRDNSKNTLY LQMNSLRAED TAVYYCARVA RGIAARSRTS YFDYWGQGTL   120
VTVSSASTKG PSVFPLAPSS KS                                            142

M161-C11 LC (SEQ ID NO: 334)
QSALTQPPSV SVSPGQTASI TCSGDKLGDK YVSWYQQRPG QSPVLVIYQD TKRPSGIPER    60
FSGSNSGNTA TLTISGTQAV DEADYYCQAW DSSTYVFGGG TKVTVL                  106

M161-C11 HC (SEQ ID NO: 335)
EVQLLESGGG LVQPGGSLRL SCAASGFTFS DYAMKWVRQA PGKGLEWVSS ISSSGGVTQY    60
ADSVKGRFTI SRDNSKNTLY LQMNSLRAED TAVYYCAREE DYSSSWYSRR FDYYYGMDVW   120
GQGTTVTVSS ASTKGPSVFP LAPSSKS                                       147

M162-A04 LC (SEQ ID NO: 336)
QDIQMTQSPS TLSASVGDRV TITCRASQSI SSWLAWYQQK PGKAPNLLIY KASTLESGVP    60
SRFSGSGSGT EFTLTISSLQ PDDFATYYCQ QYNTYWTFGQ GTKVEIK                 107
```

```
M162-A04 HC (SEQ ID NO: 337)
EVQLLESGGG LVQPGGSLRL SCAASGFTFS HYIMMWVRQA PGKGLEWVSG IYSSGGITVY    60
ADSVKGRFTI SRDNSKNTLY LQMNSLRAED TAVYYCAYRR TGIPRRDAFD IWGQGTMVTV   120
SSASTKGPSV FPLAPSSKS                                                139

X67-B03 LC (SEQ ID NO: 338)
QDIQMTQSPS SLSAFVGDRV TITCRASQPI DNYLNWYHQK PGKAPKLLIY AASRLQSGVP    60
SRLSGSGFGT DFTLTISSLQ PEDFGNYYCQ QSYTVPYTFG GGTKVEIR                108

X67-B03 HC (SEQ ID NO: 339)
EVQLLESGGG LVQPGGSLRL SCAASGFTFS AYSMIWVRQA PGKGLEWVSY IRPSGGRTTY    60
ADSVKGRFTI SRDNSKNTLY LQMNSLRAED TAVYYCARGG LLLWSRELKS NYFDYWGQGT   120
LVTVSSASTK GPSVFPLAPS SKS                                           143

X67-C03 LC (SEQ ID NO: 340)
QDIQMTQSPS SLSAFVGDRV TITCRASQPI DNYLNWYHQK PGKAPKLLIY AASRLQSGVP    60
SRLSGSGFGT DFTLTISSLQ PEDFGNYYCQ QSYTVPYTFG GGTKVEIR                108

X67-C03 HC (SEQ ID NO: 341)
EVQLLESGGG LVQPGGSLRL SCAASGFTFS AYSMIWVRQA PGKGLEWVSY IRPSGGRTTY    60
ADSVKGRFTI SRDNSKNTLY LQMNSLRAED TAVYYCARGG LLLWMRELKS NYFDYWGQGT   120
LVTVSSASTK GPSVFPLAPS SKS                                           143

X67-C09 LC (SEQ ID NO: 342)
QDIQMTQSPS SLSAFVGDRV TITCRASQPI DNYLNWYHQK PGKAPKLLIY AASRLQSGVP    60
SRLSGSGFGT DFTLTISSLQ PEDFGNYYCQ QSYTVPYTFG GGTKVEIR                108

X67-C09 HC (SEQ ID NO: 343)
EVQLLESGGG LVQPGGSLRL SCAASGFTFS AYSMIWVRQA PGKGLEWVSY IRPSGGRTTY    60
ADSVKGRFTI SRDNSKNTLY LQMNSLRAED TAVYYCARGG LLLWGRELKS NYFDYWGQGT   120
LVTVSSASTK GPSVFPLAPS SKS                                           143

X67-D03 LC (SEQ ID NO: 344)
QDIQMTQSPS SLSAFVGDRV TITCRASQPI DNYLNWYHQK PGKAPKLLIY AASRLQSGVP    60
SRLSGSGFGT DFTLTISSLQ PEDFGNYYCQ QSYTVPYTFG GGTKVEIR                108

X67-D03 HC (SEQ ID NO: 345)
EVQLLESGGG LVQPGGSLRL SCAASGFTFS AYSMIWVRQA PGKGLEWVSY IRPSGGRTTY    60
ADSVKGRFTI SRDNSKNTLY LQMNSLRAED TAVYYCARGG LLLWNRELKS NYFDYWGQGT   120
LVTVSSASTK GPSVFPLAPS SKS                                           143

X67-E04 LC (SEQ ID NO: 346)
QDIQMTQSPS SLSAFVGDRV TITCRASQPI DNYLNWYHQK PGKAPKLLIY AASRLQSGVP    60
SRLSGSGFGT DFTLTISSLQ PEDFGNYYCQ QSYTVPYTFG GGTKVEIR                108

X67-E04 HC (SEQ ID NO: 347)
EVQLLESGGG LVQPGGSLRL SCAASGFTFS AYSMIWVRQA PGKGLEWVSY IRPSGGRTTY    60
ADSVKGRFTI SRDNSKNTLY LQMNSLRAED TAVYYCARGG LLLWDRELKS NYFDYWGQGT   120
LVTVSSASTK GPSVFPLAPS SKS                                           143

X67-F01 LC (SEQ ID NO: 348)
QDIQMTQSPS SLSAFVGDRV TITCRASQPI DNYLNWYHQK PGKAPKLLIY AASRLQSGVP    60
SRLSGSGFGT DFTLTISSLQ PEDFGNYYCQ QSYTVPYTFG GGTKVEIR                108

X67-F01 HC (SEQ ID NO: 349)
EVQLLESGGG LVQPGGSLRL SCAASGFTFS AYSMIWVRQA PGKGLEWVSY IRPSGGRTTY    60
ADSVKGRFTI SRDNSKNTLY LQMNSLRAED TAVYYCARGG LLLWQRELKS NYFDYWGQGT   120
LVTVSSASTK GPSVFPLAPS SKS                                           143

X67-F10 LC (SEQ ID NO: 350)
QDIQMTQSPS SLSAFVGDRV TITCRASQPI DNYLNWYHQK PGKAPKLLIY AASRLQSGVP    60
SRLSGSGFGT DFTLTISSLQ PEDFGNYYCQ QSYTVPYTFG GGTKVEIR                108

X67-F10 HC (SEQ ID NO: 351)
EVQLLESGGG LVQPGGSLRL SCAASGFTFS AYSMIWVRQA PGKGLEWVSY IRPSGGRTTY    60
ADSVKGRFTI SRDNSKNTLY LQMNSLRAED TAVYYCARGG LLLWTRELKS NYFDYWGQGT   120
LVTVSSASTK GPSVFPLAPS SKS                                           143

X67-G04 LC (SEQ ID NO: 352)
QDIQMTQSPS SLSAFVGDRV TITCRASQPI DNYLNWYHQK PGKAPKLLIY AASRLQSGVP    60
SRLSGSGFGT DFTLTISSLQ PEDFGNYYCQ QSYTVPYTFG GGTKVEIR                108

X67-G04 HC (SEQ ID NO: 353)
EVQLLESGGG LVQPGGSLRL SCAASGFTFS AYSMIWVRQA PGKGLEWVSY IRPSGGRTTY    60
ADSVKGRFTI SRDNSKNTLY LQMNSLRAED TAVYYCARGG LLLWARELKS NYFDYWGQGT   120
LVTVSSASTK GPSVFPLAPS SKS                                           143

X67-H04 LC (SEQ ID NO: 354)
QDIQMTQSPS SLSAFVGDRV TITCRASQPI DNYLNWYHQK PGKAPKLLIY AASRLQSGVP    60
SRLSGSGFGT DFTLTISSLQ PEDFGNYYCQ QSYTVPYTFG GGTKVEIR                108
```

-continued

```
X67-H04 HC (SEQ ID NO: 355)
EVQLLESGGG LVQPGGSLRL SCAASGFTFS AYSMIWVRQA PGKGLEWVSY IRPSGGRTTY    60
ADSVKGRFTI SRDNSKNTLY LQMNSLRAED TAVYYCARGG LLLWERELKS NYFDYWGQGT   120
LVTVSSASTK GPSVFPLAPS SKS
Note:
The variable sequence of X81-B01 is the same as X63-G06 (Fab version of X81-B01, which
is an IgG), and is shown in Table 11.
```

Example 4

Lead Antibody Inhibitors

Antibodies were selected as lead plasma kallikrein inhibitors on the basis of apparent inhibition constant ($K_{i,app}$), specificity with respect to lack of inhibition of other serine proteases, inhibition of bradykinin generation, and lack of binding to plasma prekallikrein (Table 7). Plasma kallikrein circulates in the plasma as an inactive zymogen (prekallikrein) at a concentration of approximately 500 nM. Antibodies that bound prekallikrein may be rendered inaccessible towards active plasma kallikrein inhibition and could substantially increase the in vivo dose required for efficacy. Therefore, a surface plasmon resonance (SPR) assay was used to identify antibodies that do not bind prekallikrein (data not shown). Specifically, human IgGs (X81-B01, M162-A04 (R84-H05); M160-G12 (R84-D02); and M142-H08) were captured on a CM5 chip using an anti-human Fc surface and 100 nM of plasma kallikrein or 100 nM or 500 nM prekallikrein. The prekallikrein was treated with aprotinin-sepharose to remove active plasma kallikrein. The prekallikrein used for X81-B01 was buffer exchanged into the exact preparation of SPR running buffer (HEPES buffered saline) to avoid the refractive index shift that was observed with three other antibodies that were tested: M162-A04 (R84-H05); M160-G12 (R84-D02); and M142-H08.

Of the antibodies listed in Table 7, only M142-H08 inhibits human plasma kallikrein with a subnanomolar $K_{i,app}$. However, when M142-H08 was produced as an IgG it was found to be cleaved in the CDRJ of the heavy chain. Consequently, we decided to undertake two approaches to improve the affinity: 1) affinity maturation of M162-A04 and M160-G12 using a novel form of light chain shuffling called ROLIC (Rapid Optimization of Light Chains) (see, e.g., WO 2009/102927 and U.S. 2009-0215119); and 2) sequence optimization of M142-H08 in order to prevent the cleavage of the IgG that occurs while retaining the binding and inhibitor properties of M142-H08.

TABLE 7

Top Ranking Antibody Inhibitors of PKal Before Affinity Maturation or Sequence Optimization

| Criteria | M162-A04 | M160-G12 | M142-H08[a] |
|---|---|---|---|
| $K_{i,app}$ human pKal | 2 nM (as an IgG) | 5.6 nM (as an IgG) | 0.6 nM (as a Fab) |
| $K_{i,app}$ rodent pKal | 2 nM (mouse and rat) | <1 nM (mouse) | ~1 nM (mouse and rat) |
| Binds prekallikrein? | No | No | No |
| Specific inhibitor with respect to fXIa, plasmin, and trypsin | Yes | Yes | Yes |
| Inhibits bradykinin generation | Yes | Yes | Yes |

[a]When M142-H08 was produced as an IgG it was determined to be cleaved in the CDR3 of its heavy chain (GGLLLWFR-ELKSNYFDY (SEQ ID NO: 356)).

Example 5

Sequence Optimization of M142-H08

Of the antibodies listed in Table 7, only M142-H08 inhibits human pKal with a subnanomolar $K_{i,app}$. However, when M142-H08 was produced as an IgG it was found to be cleaved in the CDR3 of the heavy chain. M142-H08 was found by mass spectrometry to be cleaved after the arginine in the "WFR" sequence of the HC-CDR3 sequence (GGLLLW-FRELKSNYFDY (SEQ ID NO: 357)). This cleavage suggests that a protease from the cells used to express the antibody (both CHO and 293T human kidney cells) is enzymatically cleaving the antibody at a single specific site. We mutated the HC-CDR3 sequence of M142-H08 in order to identify amino acid substitutions that prevent the cleavage of the IgG that occurs while retaining the binding and inhibitor properties of M142-H08. Previous experience with similarly "clipped" antibodies suggested that focusing simply on the putative P1 position (protease subsite 1, see Table 8) may not be sufficient to identify antibodies that retain potent inhibition of the target enzyme while not being clipped by a host cell protease. Therefore, we created a small library of single point mutations in the region around the cleavage site in order to identify variants of M142-H08 that are not clipped but are still potent pKal inhibitors. We refer to this library as the "CDR3 by Design" library. The small library was constructed using a PCR primer that contains the randomized codon NNK at either the P3, the P2, the P1, or the P1' site. This results in a small library where each of the 4 positions may contain any of the 20 amino acids (20+20+20+20=80 members). Using PCR, this library was cloned into the M142-H08 Fab sequence in the pMid21 vector, which is a standard phagemid vector.

TABLE 8

Primer sequences

| Primer Name | Sequence | SEQ ID NO: | N |
|---|---|---|---|
| |                   P3 P2 P1 P1' P2'<br>G G L L L W F R E L K<br>S N Y | 358 | |

TABLE 8-continued

Primer sequences

| Primer Name | Sequence | SEQ ID NO: | N |
|---|---|---|---|
| 559A.P1.top | GGC GGT CTA TTA CTA TGG TTC NNK GAG CTG AAG TCT AAC TAC | 359 | 20 |
| 559A.P2.top | GGC GGT CTA TTA CTA TGG NNK AGG GAG CTG AAG TCT AAC TAC | 360 | 20 |
| 559A.P3.top | GGC GGT CTA TTA CTA NNK TTC AGG GAG CTG AAG TCT AAC TAC | 361 | 20 |
| 559A.P1p.top | GGC GGT CTA TTA CTA TGG TTC AGG NNK CTG AAG TCT AAC TAC | 362 | 20 |

By DNA sequencing, we recovered 61 of the possible 80 antibodies (Table 9). These antibodies were produced as Fab fragments in small scale (~20 µg) and tested for inhibition against human pKal in an in vitro protease cleavage assay using Pro-Phe-Arg-aminomethylcoumarin as the synthetic peptide substrate. The Fabs that were found to be inhibitors of human pKal were subcloned into our pBRH1f vector (a vector for transient expression of IgGs in 293T cells) for conversion to full length human IgG1 antibodies. Five antibodies were then expressed in 293T cells and purified by protein A sepharose chromatography. The antibodies were analyzed by SDS-PAGE to determine which of the inhibitory mutants are not cleaved by the host cell protease(s) (data not shown). The cleaved antibodies (559A-X67-G05, 559A-X67-H01, 559A-X67-G09) had an extra band that migrated between the 38 and the 49 kDa molecular weight marker. This band is absent in the 559A-X67-H04 and 559A-X67-D03 antibodies, which indicates that these antibodies are intact.

$K_{i,app}$ values were determined by steady state enzyme kinetics for those that were shown by SDS-PAGE to be not cleaved (Table 9). Interestingly, the P2 position was the only position where amino acid substitutions yielded intact antibody inhibitors of pKal. Of the 14 different mutations that were recovered at the P3 position (Table 9), only one mutant (W to L) was found to be a pKal inhibitor as a Fab but it was subsequently shown to be clipped as an IgG. None of the 16 different mutations at the P1 position (Table 9) were found to be pKal inhibitors. Eight of the 15 different mutations at the P1' position were found to be inhibitors of pKal as a Fab but all were clipped as an IgG. Consequently, only mutations at the P2 position led to antibody inhibitors that were not clipped during expression. Of the 16 different mutations that were recovered at the P2 position (Table 9), eight mutants were found to be a pKal inhibitor as a Fab but it was subsequently shown to be clipped as an IgG. Four mutants at the P2 position were found to have subnanomolar $K_{i,app}$ values: X67-G04 (F to A), X67-CO3 (F to M), X67-F01 (F to Q) and X67-D03 (F to N). The antibody with the highest potency is X67-D03 ($K_{i,app}$=0.1 nM). The two antibodies shown in Table 10 were not cleaved when expressed as IgGs and were found to inhibit pKal with a subnanomolar $K_{i,app}$.

DNA and amino acid sequence alignments of the light chains of nongermlined (X63-G06) and germlined, codon optimized (X81-B01) versions of the same antibody discovered using ROLIC affinity maturation are shown in FIGS. 3 and 4, respectively. DNA and amino acid sequence alignments of the heavy chains of nongermlined (X63-G06) and germlined, codon optimized (X81-B01) versions of the same antibody discovered using ROLIC affinity maturation are shown in FIGS. 5 and 6, respectively.

TABLE 9

HV-CDR3 Sequences Obtained from "CDR3 by Design" Library*

| Mutation Site | Antibody I.D. | HV-CDR3 (SEQ ID NOS 363-424, respectively, in order of appearance) | Inhibit as a Fab? | Intact as an IgG? | Ki, app as an IgG (nM) |
|---|---|---|---|---|---|
| Parental | X69-C09 | GGLLLWFRELKSNYFDY | Yes | No | 0.2 |
| P3 | X68-E07 | GGLLLAFRELKSNYFDY | No | n/a | n/a |
| P3 | X68-E12 | GGLLLCFRELKSNYFDY | No | n/a | n/a |
| P3 | X68-A03 | GGLLLDFRELKSNYFDY | No | n/a | n/a |
| P3 | X68-E03 | GGLLLEFRELKSNYFDY | No | n/a | n/a |
| P3 | X68-A12 | GGLLLGFRELKSNYFDY | No | n/a | n/a |
| P3 | X68-D11 | GGLLLKFRELKSNYFDY | No | n/a | n/a |
| P3 | X68-E01 | GGLLLLFRELKSNYFDY | Yes | No | n/a |
| P3 | X68-F05 | GGLLLMFRELKSNYFDY | No | n/a | n/a |
| P3 | X68-D10 | GGLLLPFRELKSNYFDY | No | n/a | n/a |

TABLE 9-continued

HV-CDR3 Sequences Obtained from "CDR3 by Design" Library*

| Mutation Site | Antibody I.D. | HV-CDR3 (SEQ ID NOS 363-424, respectively, in order of appearance) | Inhibit as a Fab? | Intact as an IgG? | Ki, app as an IgG (nM) |
|---|---|---|---|---|---|
| P3 | X68-F10 | GGLLLQFRELKSNYFDY | No | n/a | n/a |
| P3 | X68-G01 | GGLLLRFRELKSNYFDY | No | n/a | n/a |
| P3 | X68-G05 | GGLLLSFRELKSNYFDY | No | n/a | n/a |
| P3 | X68-F12 | GGLLLTFRELKSNYFDY | No | n/a | n/a |
| P3 | X68-H04 | GGLLLVFRELKSNYFDY | No | n/a | n/a |
| P2 | X67-G04 | GGLLLWARELKSNYFDY | Yes | Yes | 0.35 |
| P2 | X67-G01 | GGLLLWCRELKSNYFDY | No | n/a | n/a |
| P2 | X67-E04 | GGLLLWDRELKSNYFDY | Yes | Yes | 1.3 |
| P2 | X67-H04 | GGLLLWERELKSNYFDY | Yes | Yes | 3.6 |
| P2 | X67-C09 | GGLLLWGRELKSNYFDY | Yes | Yes | 8.6 |
| P2 | X67-B04 | GGLLLWKRELKSNYFDY | Yes | No | n/a |
| P2 | X67-G09 | GGLLLWLRELKSNYFDY | Yes | No | n/a |
| P2 | X67-C03 | GGLLLWMRELKSNYFDY | Yes | Yes | 0.7 |
| P2 | X67-D03 | GGLLLWNRELKSNYFDY | Yes | Yes | 0.1 |
| P2 | X67-B05 | GGLLLWPRELKSNYFDY | No | n/a | n/a |
| P2 | X67-F01 | GGLLLWQRELKSNYFDY | Yes | Yes | 0.9 |
| P2 | X67-G05 | GGLLLWRRELKSNYFDY | Yes | No | n/a |
| P2 | X67-B03 | GGLLLWSRELKSNYFDY | Yes | Yes | 2.1 |
| P2 | X67-F10 | GGLLLWTRELKSNYFDY | Yes | Yes | 1.3 |
| P2 | X67-H01 | GGLLLWWRELKSNYFDY | Yes | No | n/a |
| P2 | X67-F08 | GGLLLWYRELKSNYFDY | Yes | No | n/a |
| P1 | X66-E09 | GGLLLWFAELKSNYFDY | No | n/a | n/a |
| P1 | X66-B05 | GGLLLWFCELKSNYFDY | No | n/a | n/a |
| P1 | X66-D03 | GGLLLWFEELKSNYFDY | No | n/a | n/a |
| P1 | X66-H04 | GGLLLWFFELKSNYFDY | No | n/a | n/a |
| P1 | X66-H02 | GGLLLWFGELKSNYFDY | No | n/a | n/a |
| P1 | X66-C11 | GGLLLWFHELKSNYFDY | No | n/a | n/a |
| P1 | X66-A07 | GGLLLWFKELKSNYFDY | No | n/a | n/a |
| P1 | X66-C03 | GGLLLWFLELKSNYFDY | No | n/a | n/a |
| P1 | X66-G05 | GGLLLWFMELKSNYFDY | No | n/a | n/a |
| P1 | X66-F10 | GGLLLWFPELKSNYFDY | No | n/a | n/a |
| P1 | X66-E04 | GGLLLWFQELKSNYFDY | No | n/a | n/a |
| P1 | X66-F01 | GGLLLWFSELKSNYFDY | No | n/a | n/a |
| P1 | X66-H11 | GGLLLWFTELKSNYFDY | No | n/a | n/a |
| P1 | X66-C02 | GGLLLWFVELKSNYFDY | No | n/a | n/a |
| P1 | X66-F09 | GGLLLWFWELKSNYFDY | No | n/a | n/a |

TABLE 9-continued

HV-CDR3 Sequences Obtained from "CDR3 by Design" Library*

| Mutation Site | Antibody I.D. | HV-CDR3 (SEQ ID NOS 363-424, respectively, in order of appearance) | Inhibit as a Fab? | Intact as an IgG? | Ki, app as an IgG (nM) |
|---|---|---|---|---|---|
| P1 | X66-G08 | GGLLLWFYELKSNYFDY | No | n/a | n/a |
| P1' | X69-D08 | GGLLLWFRALKSNYFDY | No | n/a | n/a |
| P1' | X69-B02 | GGLLLWFRCLKSNYFDY | No | n/a | n/a |
| P1' | X69-D09 | GGLLLWFRGLKSNYFDY | Yes | No | n/a |
| P1' | X69-D02 | GGLLLWFRHLKSNYFDY | No | n/a | n/a |
| P1' | X69-A12 | GGLLLWFRKLKSNYFDY | No | n/a | n/a |
| P1' | X69-F05 | GGLLLWFRLLKSNYFDY | Yes | No | n/a |
| P1' | X69-B08 | GGLLLWFRNLKSNYFDY | Yes | No | n/a |
| P1' | X69-A10 | GGLLLWFRPLKSNYFDY | No | n/a | n/a |
| P1' | X69-A09 | GGLLLWFRQLKSNYFDY | Yes | No | n/a |
| P1' | X69-E05 | GGLLLWFRRLKSNYFDY | No | n/a | n/a |
| P1' | X69-F09 | GGLLLWFRSLKSNYFDY | Yes | No | n/a |
| P1' | X69-F01 | GGLLLWFRTLKSNYFDY | Yes | No | n/a |
| P1' | X69-C12 | GGLLLWFRVLKSNYFDY | Yes | No | n/a |
| P1' | X69-E01 | GGLLLWFRWLKSNYFDY | Yes | No | n/a |
| P1' | X69-H10 | GGLLLWFRYLKSNYFDY | No | n/a | n/a |

*All of these antibodies are single point mutations of the M142-H08 sequence.

Amino acid sequences of light chain (LC) and heavy chain (HC) variable domain of pKal antibodies with designed HC CDR3s are shown below.

```
X68-E07 LC (SEQ ID NO: 425)
QDIQMTQSPS SLSAFVGDRV TITCRASQPI DNYLNWYHQK PGKAPKLLIY AASRLQSGVP    60
SRLSGSGFGT DFTLTISSLQ PEDFGNYYCQ QSYTVPYTFG GGTKVEIR                108

X68-E07 HC (SEQ ID NO: 426)
EVQLLESGGG LVQPGGSLRL SCAASGFTFS AYSMIWVRQA PGKGLEWVSY IRPSGGRTTY    60
ADSVKGRFTI SRDNSKNTLY LQMNSLRAED TAVYYCARGG LLLAFRELKS NYFDYWGQGT   120
LVTVSSASTK GPSVFPLAPS SKS                                          143

X68-E12 LC (SEQ ID NO: 427)
QDIQMTQSPS SLSAFVGDRV TITCRASQPI DNYLNWYHQK PGKAPKLLIY AASRLQSGVP    60
SRLSGSGFGT DFTLTISSLQ PEDFGNYYCQ QSYTVPYTFG GGTKVEIR                108

X68-E12 HC (SEQ ID NO: 428)
EVQLLESGGG LVQPGGSLRL SCAASGFTFS AYSMIWVRQA PGKGLEWVSY IRPSGGRTTY    60
ADSVKGRFTI SRDNSKNTLY LQMNSLRAED TAVYYCARGG LLLCFRELKS NYFDYWGQGT   120
LVTVSSASTK GPSVFPLAPS SKS                                          143

X68-A03 LC (SEQ ID NO: 429)
QDIQMTQSPS SLSAFVGDRV TITCRASQPI DNYLNWYHQK PGKAPKLLIY AASRLQSGVP    60
SRLSGSGFGT DFTLTISSLQ PEDFSNYYCQ QSYTVPYTFG GGTKVEIR                108

X68-A03 HC (SEQ ID NO: 430)
EVQLLESGGG LVQPGGSLRL SCAASGFTFS AYSMIWVRQA PGKGLEWVSY IRPSGGRTTY    60
ADSVKGRFTI SRDNSKNTLY LQMNSLRAED TAVYYCARGG LLLDFRELKS NYFDYWGQGT   120
LVTVSSASTK GPSVFPLAPS SKS                                          143

X68-E03 LC (SEQ ID NO: 431)
QDIQMTQSPS SLSAFVGDRV TITCRASQPI DNYLNWYHQK PGKAPKLLIY AASRLQSGVP    60
SRLSGSGFGT DFTLTISSLQ PEDFGNYYCQ QSYTVPYTFG GGTKVEIR                108
```

```
X68-E03 HC (SEQ ID NO: 432)
EVQLLESGGG LVQPGGSLRL SCAASGFTFS AYSMIWVRQA PGKGLEWVSY IRPSGGRTTY   60
ADSVKGRFTI SRDNSKNTLY LQMNSLRAED TAVYYCARGG LLLEFRELKS NYFDYWGQGT  120
LVTVSSASTK GPSVFPLAPS SKS                                         143

X68-A12 LC (SEQ ID NO: 433)
QDIQMTQSPS SLSAFVGDRV TITCRASQPI DNYLNWYHQK PGKAPKLLIY AASRLQSGVP   60
SRLSGSGFGT DFTLTISSLQ PEDFGNYYCQ QSYTVPYTFG GGTKVEIR              108

X68-A12 HC (SEQ ID NO: 434)
EVQLLESGGG LVQPGGSLRL SCAASGFTFS AYSMIWVRQA PGKGLEWVSY IRPSGGRTTY   60
ADSVKGRFTI SRDNSKNTLY LQMNSLRAED TAVYYCARGG LLLGFRELKS NYFDYWGQGT  120
LVTVSSASTK GPSVFPLAPS SKS                                         143

X68-D11 LC (SEQ ID NO: 435)
QDIQMTQSPS SLSAFVGDRV TITCRASQPI DNYLNWYHQK PGKAPKLLIY AASRLQSGVP   60
SRLSGSGFGT DFTLTISSLQ PEDFGNYYCQ QSYTVPYTFG GGTKVEIR              108

X68-D11 HC (SEQ ID NO: 435)
EVQLLESGGG LVQPGGSLRL SCAASGFTFS AYSMIWVRQA PGKGLEWVSY IRPSGGRTTY   60
ADSVKGRFTI SRDNSKNTLY LQMNSLRAED TAVYYCARGG LLLKFRELKS NYFDYWGQGT  120
LVTVSSASTK GPSVFPLAPS SKS                                         143

X68-E01 LC (SEQ ID NO: 437)
QDIQMTQSPS SLSAFVGDRV TITCRASQPI DNYLNWYHQK PGKAPKLLIY AASRLQSGVP   60
SRLSGSGFGT DFTLTISSLQ PEDFGNYYCQ QSYTVPYTFG GGTKVEIR              108

X68-E01 HC (SEQ ID NO: 438)
EVQLLESGGG LVQPGGSLRL SCAASGFTFS AYSMIWVRQA PGKGLEWVSY IRPSGGRTTY   60
ADSVKGRFTI SRDNSKNTLY LQMNSLRAED TAVYYCARGG LLLLFRELKS NYFDYWGQGT  120
LVTVSSASTK GPSVFPLAPS SKS                                         143

X68-F05 LC (SEQ ID NO: 439)
QDIQMTQSPS SLSAFVGDRV TITCRASQPI DNYLNWYHQK PGKAPKLLIY AASRLQSGVP   60
SRLSGSGFGT DFTLTISSLQ PEDFGNYYCQ QSYTVPYTFG GGTKVEIR              108

X68-F05 HC (SEQ ID NO: 440)
EVQLLESGGG LVQPGGSLRL SCAASGFTFS AYSMIWVRQA PGKGLEWVSY IRPSGGRTTY   60
ADSVKGRFTI SRDNSKNTLY LQMNSLRAED TAVYYCARGG LLLMFRELKS NYFDYWGQGT  120
LVTVSSASTK GPSVFPLAPS SKS                                         143

X68-D10 LC (SEQ ID NO: 441)
QDIQMTQSPS SLSAFVGDRV TITCRASQPI DNYLNWYHQK PGKAPKLLIY AASRLQSGVP   60
SRLSGSGFGT DFTLTISSLQ PEDFGNYYCQ QSYTVPYTFG GGTKVEIR              108

X68-D10 HC (SEQ ID NO: 442)
EVQLLESGGG LVQPGGSLRL SCAASGFTFS AYSMIWVRQA PGKGLEWVSY IRPSGGRTTY   60
ADSVKGRFTI SRDNSKNTLY LQMNSLRAED TAVYYCARGG LLLPFRELKS NYFDYWGQGT  120
LVTVSSASTK GPSVFPLAPS SKS                                         143

X68-F10 LC (SEQ ID NO: 443)
QDIQMTQSPS SLSAFVGDRV TITCRASQPI DNYLNWYHQK PGKAPKLLIY AASRLQSGVP   60
SRLSGSGFGT DFTLTISSLQ PEDFGNYYCQ QSYTVPYTFG GGTKVEIR              108

X68-F10 HC (SEQ ID NO: 444)
EVQLLESGGG LVQPGGSLRL SCAASGFTFS AYSMIWVRQA PGKGLEWVSY IRPSGGRTTY   60
ADSVKGRFTI SRDNSKNTLY LQMNSLRAED TAVYYCARGG LLLQFRELKS NYFDYWGQGT  120
LVTVSSASTK GPSVFPLAPS SKS                                         143

X68-G01 LC (SEQ ID NO: 445)
QDIQMTQSPS SLSAFVGDRV TITCRASQPI DNYLNWYHQK PGKAPKLLIY AASRLQSGVP   60
SRLSGSGFGT DFTLTISSLQ PEDFGNYYCQ QSYTVPYTFG GGTKVEIR              108

X68-G01 HC (SEQ ID NO: 446)
EVQLLESGGG LVQPGGSLRL SCAASGFTFS AYSMIWVRQA PGKGLEWVSY IRPSGGRTTY   60
ADSVKGRFTI SRDNSKNTLY LQMNSLRAED TAVYYCARGG LLLRFRELKS NYFDYWGQGT  120
LVTVSSASTK GPSVFPLAPS SKS                                         143

X68-G05 LC (SEQ ID NO: 447)
QDIQMTQSPS SLSAFVGDRV TITCRASQPI DNYLNWYHQK PGKAPKLLIY AASRLQSGVP   60
SRLSGSGFGT DFTLTISSLQ PEDFGNYYCQ QSYTVPYTFG GGTKVEIR              108

X68-G05 HC (SEQ ID NO: 448)
EVQLLESGGG LVQPGGSLRL SCAASGFTFS AYSMIWVRQA PGKGLEWVSY IRPSGGRTTY   60
ADSVKGRFTI SRDNSKNILY LQMNSLRAED TAVYYCARGG LLLSFRELKS NYFDYWGQGT  120
LVTVSSASTK GPSVFPLAPS SKS                                         143

X68-F12 LC (SEQ ID NO: 449)
QDIQMTQSPS SLSAFVGDRV TITCRASQPI DNYLNWYHQK PGKAPKLLIY AASRLQSGVP   60
SRLSGSGFGT DFTLTISSLQ PEDFGNYYCQ QSYTVPYTFG GGTKVEIR              108
```

-continued

```
X68-F12 HC (SEQ ID NO: 450)
EVQLLESGGG LVQPGGSLRL SCAASGFTFS AYSMIWVRQA PGKGLEWVSY IRPSGGRTTY    60
ADSVKGRFTI SRDNSKNTLY LQMNSLRAED TAVYYCARGG LLLTFRELKS NYFDYWGQGT   120
LVTVSSASTK GPSVFPLAPS SKS                                          143

X68-H04 LC (SEQ ID NO: 451)
QDIQMTQSPS SLSAFVGDRV TITCRASQPI DNYLNWYHQK PGKAPKLLIY AASRLQSGVP    60
SRLSGSGFGT DFTLTISSLQ PEDFGNYYCQ QSYTVPYTFG GGTKVEIR               108

X68-H04 HC (SEQ ID NO: 452)
EVQLLESGGG LVQPGGSLRL SCAASGFTFS AYSMIWVRQA PGKGLEWVSY IRPSGGRTTY    60
ADSVKGRFTI SRDNSKNTLY LQMNSLRAED TAVYYCARGG LLLVFRELKS NYFDYWGQGT   120
LVTVSSASTK GPSVFPLAPS SKS                                          143

X67-G04 LC (SEQ ID NO: 453)
QDIQMTQSPS SLSAFVGDRV TITCRASQPI DNYLNWYHQK PGKAPKLLIY AASRLQSGVP    60
SRLSGSGFGT DFTLTISSLQ PEDFGNYYCQ QSYTVPYTFG GGTKVEIR               108

X67-G04 HC (SEQ ID NO: 454)
EVQLLESGGG LVQPGGSLRL SCAASGFTFS AYSMIWVRQA PGKGLEWVSY IRPSGGRTTY    60
ADSVKGRFTI SRDNSKNTLY LQMNSLRAED TAVYYCARGG LLLWARELKS NYFDYWGQGT   120
LVTVSSASTK GPSVFPLAPS SKS                                          143

X67-G01 LC (SEQ ID NO: 455)
QDIQMTQSPS SLSAFVGDRV TITCRASQPI DNYLNWYHQK PGKAPKLLIY AASRLQSGVP    60
SRLSGSGFGT DFTLTISSLQ PEDFGNYYCQ QSYTVPYTFG GGTKVEIR               108

X67-G01 HC (SEQ ID NO: 456)
EVQLLESGGG LVQPGGSLRL SCAASGFTFS AYSMIWVRQA PGKGLEWVSY IRPSGGRTTY    60
ADSVKGRFTI SRDNSKNTLY LQMNSLRAED TAVYYCARGG LLLWCRELKS NYFDYWGQGT   120
LVTVSSASTK GPSVFPLAPS SKS                                          143

X67-E04 LC (SEQ ID NO: 457)
QDIQMTQSPS SLSAFVGDRV TITCRASQPI DNYLNWYHQK PGKAPKLLIY AASRLQSGVP    60
SRLSGSGFGT DFTLTISSLQ PEDFGNYYCQ QSYTVPYTFG GGTKVEIR               108

X67-E04 HC (SEQ ID NO: 458)
EVQLLESGGG LVQPGGSLRL SCAASGFTFS AYSMIWVRQA PGKGLEWVSY IRPSGGRTTY    60
ADSVKGRFTI SRDNSKNTLY LQMNSLRAED TAVYYCARGG LLLWDRELKS NYFDYWGQGT   120
LVTVSSASTK GPSVFPLAPS SKS                                          143

X67-H04 LC (SEQ ID NO: 459)
QDIQMTQSPS SLSAFVGDRV TITCRASQPI DNYLNWYHQK PGKAPKLLIY AASRLQSGVP    60
SRLSGSGFGT DFTLTISSLQ PEDFGNYYCQ QSYTVPYTFG GGTKVEIR               108

X67-H04 HC (SEQ ID NO: 460)
EVQLLESGGG LVQPGGSLRL SCAASGFTFS AYSMIWVRQA PGKGLEWVSY IRPSGGRTTY    60
ADSVKGRFTI SRDNSKNTLY LQMNSLRAED TAVYYCARGG LLLWERELKS NYFDYWGQGT   120
LVTVSSASTK GPSVFPLAPS SKS                                          143

X66-E09 LC (SEQ ID NO: 461)
QDIQMTQSPS SLSAFVGDRV TITCRASQPI DNYLNWYHQK PGKAPKLLIY AASRLQSGVP    60
SRLSGSGFGT DFTLTISSLQ PEDFGNYYCQ QSYTVPYTFG GGTKVEIR               108

X66-E09 HC (SEQ ID NO: 462)
EVQLLESGGG LVQPGGSLRL SCAASGFTFS AYSMIWVRQA PGKGLEWVSY IRPSGGRTTY    60
ADSVKGRFTI SRDNSKNTLY LQMNSLRAED TAVYYCARGG LLLWFAELKS NYFDYWGQGT   120
LVTVSSASTK GPSVFPLAPS SKS                                          143

X66-B05 LC (SEQ ID NO: 463)
QDIQMTQSPS SLSAFVGDRV TITCRASQPI DNYLNWYHQK PGKAPKLLIY AASRLQSGVP    60
SRLSGSGFGT DFTLTISSLQ PEDFGNYYCQ QSYTVPYTFG GGTKVEIR               108

X66-B05 HC (SEQ ID NO: 464)
EVQLLESGGG LVQPGGSLRL SCAASGFTFS AYSMIWVRQA PGKGLEWVSY IRPSGGRTTY    60
ADSVKGRFTI SRDNSKNTLY LQMNSLRAED TAVYYCARGG LLLWFCELKS NYFDYWGQGT   120
LVTVSSASTK GPSVFPLAPS SKS                                          143

X66-D03 LC (SEQ ID NO: 465)
QDIQMTQSPS SLSAFVGDRV TITCRASQPI DNYLNWYHQK PGKAPKLLIY AASRLQSGVP    60
SRLSGSGFGT DFTLTISSLQ PEDFGNYYCQ QSYTVPYTFG GGTKVEIR               108

X66-D03 HC (SEQ ID NO: 466)
EVQLLESGGG LVQPGGSLRL SCAASGFTFS AYSMIWVRQA PGKGLEWVSY IRPSGGRTTY    60
ADSVKGRFTI SRDNSKNTLY LQMNSLRAED TAVYYCARGG LLLWFEELKS NYFDYWGQGT   120
LVTVSSASTK GPSVFPLAPS SKS                                          143

X66-H04 LC (SEQ ID NO: 467)
QDIQMTQSPS SLSAFVGDRV TITCRASQPI DNYLNWYHQK PGKAPKLLIY AASRLQSGVP    60
SRLSGSGFGT DFTLTISSLQ PEDFGNYYCQ QSYTVPYTFG GGTKVEIR               108
```

```
X66-H04 HC (SEQ ID NO: 468)
EVQLLESGGG LVQPGGSLRL SCAASGFTFS AYSMIWVRQA PGKGLEWVSY IRPSGGRTTY    60
ADSVKGRFTI SRDNSKNTLY LQMNSLRAED TAVYYCARGG LLLWFFELKS NYFDYWGQGT   120
LVTVSSASTK GPSVFPLAPS SKS                                          143

X66-H02 LC (SEQ ID NO: 469)
QDIQMTQSPS SLSAFVGDRV TITCRASQPI DNYLNWYHQK PGKAPKLLIY AASRLQSGVP    60
SRLSGSGFGT DFTLTISSLQ PEDFGNYYCQ QSYTVPYTFG GGTKVEIR                108

X66-H02 HC (SEQ ID NO: 470)
EVQLLESGGG LVQPGGSLRL SCAASGFTFS AYSMIWVRQA PGKGLEWVSY IRPSGGRTTY    60
ADSVKGRFTI SRDNSKNTLY LQMNSLRAED TAVYYCARGG LLLWFGELKS NYFDYWGQGT   120
LVTVSSASTK GPSVFPLAPS SKS                                          143

X66-C11 LC (SEQ ID NO: 471)
QDIQMTQSPS SLSAFVGDRV TITCRASQPI DNYLNWYHQK PGKAPKLLIY AASRLQSGVP    60
SRLSGSGFGT DFTLTISSLQ PEDFGNYYCQ QSYTVPYTFG GGTKVEIR                108

X66-C11 HC (SEQ ID NO: 472)
EVQLLESGGG LVQPGGSLRL SCAASGFTFS AYSMIWVRQA PGKGLEWVSY IRPSGGRTTY    60
ADSVKGRFTI SRDNSKNTLY LQMNSLRAED TAVYYCARGG LLLWFHELKS NYFDYWGQGT   120
LVTVSSASTK GPSVFPLAPS SKS                                          143

X66-A07 LC (SEQ ID NO: 473)
QDIQMTQSPS SLSAFVGDRV TITCRASQPI DNYLNWYHQK PGKAPKLLIY AASRLQSGVP    60
SRLSGSGFGT DFTLTISSLQ PEDFGNYYCQ QSYTVPYTFG GGTKVEIR                108

X66-A07 HC (SEQ ID NO: 474)
EVQLLESGGG LVQPGGSLRL SCAASGFTFS AYSMIWVRQA PGKGLEWVSY IRPSGGRTTY    60
ADSVKGRFTI SRDNSKNTLY LQMNSLRAED TAVYYCARGG LLLWFKELKS NYFDYWGQGT   120
LVTVSSASTK GPSVFPLAPS SKS                                          143

X66-C03 LC (SEQ ID NO: 475)
QDIQMTQSPS SLSAFVGDRV TITCRASQPI DNYLNWYHQK PGKAPKLLIY AASRLQSGVP    60
SRLSGSGFGT DFTLTISSLQ PEDFGNYYCQ QSYTVPYTFG GGTKVEIR                108

X66-C03 HC (SEQ ID NO: 476)
EVQLLESGGG LVQPGGSLRL SCAASGFTFS AYSMIWVRQA PGKGLEWVSY IRPSGGRTTY    60
ADSVKGRFTI SRDNSKNTLY LQMNSLRAED TAVYYCARGG LLLWFLELKS NYFDYWGQGT   120
LVTVSSASTK GPSVFPLAPS SKS                                          143

X66-G05 LC (SEQ ID NO: 477)
QDIQMTQSPS SLSAFVGDRV TITCRASQPI DNYLNWYHQK PGKAPKLLIY AASRLQSGVP    60
SRLSGSGFGT DFTLTISSLQ PEDFGNYYCQ QSYTVPYTFG GGTKVEIR                108

X66-G05 HC (SEQ ID NO: 478)
EVQLLESGGG LVQPGGSLRL SCAASGFTFS AYSMIWVRQA PGKGLEWVSY IRPSGGRTTY    60
ADSVKGRFTI SRDNSKNTLY LQMNSLRAED TAVYYCARGG LLLWFMELKS NYFDYWGQGT   120
LVTVSSASTK GPSVFPLAPS SKS                                          143

X66-F10 LC (SEQ ID NO: 479)
QDIQMTQSPS SLSAFVGDRV TITCRASQPI DNYLNWYHQK PGKAPKLLIY AASRLQSGVP    60
SRLSGSGFGT DFTLTISSLQ PEDFGNYYCQ QSYTVPYTFG GGTKVEIR                108

X66-F10 HC (SEQ ID NO: 480)
EVQLLESGGG LVQPGGSLRL SCAASGFTFS AYSMIWVRQA PGKGLEWVSY IRPSGGRTTY    60
ADSVKGRFTI SRDNSKNTLY LQMNSLRAED TAVYYCARGG LLLWFPELKS NYFDYWGQGT   120
LVTVSSASTK GPSVFPLAPS SKS                                          143

X66-E04 LC (SEQ ID NO: 481)
QDIQMTQSPS SLSAFVGDRV TITCRASQPI DNYLNWYHQK PGKAPKLLIY AASRLQSGVP    60
SRLSGSGFGT DFTLTISSLQ PEDFGNYYCQ QSYTVPYTFG GGTKVEIR                108

X66-E04 HC (SEQ ID NO: 482)
EVQLLESGGG LVQPGGSLRL SCAASGFTFS AYSMIWVRQA PGKGLEWVSY IRPSGGRTTY    60
ADSVKGRFTI SRDNSKNTLY LQMNSLRAED TAVYYCARGG LLLWFQELKS NYFDYWGQGT   120
LVTVSSASTK GPSVFPLAPS SKS                                          143

X69-D08 LC (SEQ ID NO: 483)
QDIQMTQSPS SLSAFVGDRV TITCRASQPI DNYLNWYHQK PGKAPKLLIY AASRLQSGVP    60
SRLSGSGFGT DFTLTISSLQ PEDFGNYYCQ QSYTVPYTFG GGTKVEIR                108

X69-D08 HC (SEQ ID NO: 484)
EVQLLESGGG LVQPGGSLRL SCAASGFTFS AYSMIWVRQA PGKGLEWVSY IRPSGGRTTY    60
ADSVKGRFTI SRDNSKNTLY LQMNSLRAED TAVYYCARGG LLLWFRALKS NYFDYWGQGT   120
LVTVSSASTK GPSVFPLAPS SKS                                          143

X69-B02 LC (SEQ ID NO: 485)
QDIQMTQSPS SLSAFVGDRV TITCRASQPI DNYLNWYHQK PGKAPKLLIY AASRLQSGVP    60
SRLSGSGFGT DFTLTISSLQ PEDFGNYYCQ QSYTVPYTFG GGTKVEIR                108
```

```
X69-B02 HC (SEQ ID NO: 486)
EVQLLESGGG LVQPGGSLRL SCAASGFTFS AYSMIWVRQA PGKGLEWVSY IRPSGGRTTY   60
ADSVKGRFTI SRDNSKNTLY LQMNSLRAED TAVYYCARGG LLLWFRCLKS NYFDYWGQGT  120
LVTVSSASTK GPSVFPLAPS SKS                                         143

X69-C09 LC (SEQ ID NO: 487)
QDIQMTQSPS SLSAFVGDRV TITCRASQPI DNYLNWYHQK PGKAPKLLIY AASRLQSGVP   60
SRLSGSGFGT DFTLTISSLQ PEDFGNYYCQ QSYTVPYTFG GGTKVEIR              108

X69-C09 HC (SEQ ID NO: 488)
EVQLLESGGG LVQPGGSLRL SCAASGFTFS AYSMIWVRQA PGKGLEWVSY IRPSGGRTTY   60
ADSVKGRFTI SRDNSKNTLY LQMNSLRAED TAVYYCARGG LLLWFRELKS NYFDYWGQGT  120
LVTVSSASTK GPSVFPLAPS SKS                                         143

X69-D09 LC (SEQ ID NO: 489)
QDIQMTQSPS SLSAFVGDRV TITCRASQPI DNYLNWYHQK PGKAPKLLIY AASRLQSGVP   60
SRLSGSGFGT DFTLTISSLQ PEDFGNYYCQ QSYTVPYTFG GGTKVEIR              108

X69-D09 HC (SEQ ID NO: 490)
EVQLLESGGG LVQPGGSLRL SCAASGFTFS AYSMIWVRQA PGKGLEWVSY IRPSGGRTTY   60
ADSVKGRFTI SRDNSKNTLY LQMNSLRAED TAVYYCARGG LLLWFRGLKS NYFDYWGQGT  120
LVTVSSASTK GPSVFPLAPS SKS                                         143

X69-D02 LC (SEQ ID NO: 491)
QDIQMTQSPS SLSAFVGDRV TITCRASQPI DNYLNWYHQK PGKAPKLLIY AASRLQSGVP   60
SRLSGSGFGT DFTLTISSLQ PEDFGNYYCQ QSYTVPYTFG GGTKVEIR              108

X69-D02 HC (SEQ ID NO: 492)
EVQLLESGGG LVQPGGSLRL SCAASGFTFS AYSMIWVRQA PGKGLEWVSY IRPSGGRTTY   60
ADSVKGRFTI SRDNSKNTLY LQMNSLRAED TAVYYCARGG LLLWFRHLKS NYFDYWGQGT  120
LVTVSSASTK GPSVFPLAPS SKS                                         143

X69-A12 LC (SEQ ID NO: 493)
QDIQMTQSPS SLSAFVGDRV TITCRASQPI DNYLNWYHQK PGKAPKLLIY AASRLQSGVP   60
SRLSGSGFGT DFTLTISSLQ PEDFGNYYCQ QSYTVPYTFG GGTKVEIR              108

X69-A12 HC (SEQ ID NO: 494)
EVQLLESGGG LVQPGGSLRL SCAASGFTFS AYSMIWVRQA PGKGLEWVSY IRPSGGRTTY   60
ADSVKGRFTI SRDNSKNTLY LQMNSLRAED TAVYYCARGG LLLWFRKLKS NYFDYWGQGT  120
LVTVSSASTK GPSVFPLAPS SKS                                         143

X69-F05 LC (SEQ ID NO: 495)
QDIQMTQSPS SLSAFVGDRV TITCRASQPI DNYLNWYHQK PGKAPKLLIY AASRLQSGVP   60
SRLSGSGFGT DFTLTISSLQ PEDFGNYYCQ QSYTVPYTFG GGTKVEIR              108

X69-F05 HC (SEQ ID NO: 496)
EVQLLESGGG LVQPGGSLRL SCAASGFTFS AYSMIWVRQA PGKGLEWVSY IRPSGGRTTY   60
ADSVKGRFTI SRDNSKNTLY LQMNSLRAED TAVYYCARGG LLLWFRLLKS NYFDYWGQGT  120
LVTVSSASTK GPSVFPLAPS SKS                                         143

X69-B08 LC (SEQ ID NO: 497)
QDIQMTQSPS SLSAFVGDRV TITCRASQPI DNYLNWYHQK PGKAPKLLIY AASRLQSGVP   60
SRLSGSGFGT DFTLTISSLQ PEDFGNYYCQ QSYTVPYTFG GGTKVEIR              108

X69-B08 HC (SEQ ID NO: 498)
EVQLLESGGG LVQPGGSLRL SCAASGFTFS AYSMIWVRQA PGKGLEWVSY IRPSGGRTTY   60
ADSVKGRFTI SRDNSKNTLY LQMNSLRAED TAVYYCARGG LLLWFRNLKS NYFDYWGQGT  120
LVTVSSASTK GPSVFPLAPS SKS                                         143

X69-A10 LC (SEQ ID NO: 499)
QDIQMTQSPS SLSAFVGDRV TITCRASQPI DNYLNWYHQK PGKAPKLLIY AASRLQSGVP   60
SRLSGSGFGT DFTLTISSLQ PEDFGNYYCQ QSYTVPYTFG GGTKVEIR              108

X69-A10 HC (SEQ ID NO: 500)
EVQLLESGGG LVQPGGSLRL SCAASGFTFS AYSMIWVRQA PGKGLEWVSY IRPSGGRTTY   60
ADSVKGRFTI SRDNSKNTLY LQMNSLRAED TAVYYCARGG LLLWFRPLKS NYFDYWGQGT  120
LVTVSSASTK GPSVFPLAPS SKS                                         143

X69-A09 LC (SEQ ID NO: 501)
QDIQMTQSPS SLSAFVGDRV TITCRASQPI DNYLNWYHQK PGKAPKLLIY AASRLQSGVP   60
SRLSGSGFGT DFTLTISSLQ PEDFGNYYCQ QSYTVPYTFG GGTKVEIR              108

X69-A09 HC (SEQ ID NO: 502)
EVQLLESGGG LVQPGGSLRL SCAASGFTFS AYSMIWVRQA PGKGLEWVSY IRPSGGRTTY   60
ADSVKGRFTI SRDNSKNTLY LQMNSLRAED TAVYYCARGG LLLWFRSLKS NYFDYWGQGT  120
LVTVSSASTK GPSVFPLAPS SKS                                         143

X69-E05 LC (SEQ ID NO: 503)
QDIQMTQSPS SLSAFVGDRV TITCRASQPI DNYLNWYHQK PGKAPKLLIY AASRLQSGVP   60
SRLSGSGFGT DFTLTISSLQ PEDFGNYYCQ QSYTVPYTFG GGTKVEIR              108
```

-continued

```
X69-E05 HC (SEQ ID NO: 504)
EVQLLESGGG LVQPGGSLRL SCAASGFTFS AYSMIWVRQA PGKGLEWVSY IRPSGGRTTY    60
ADSVKGRFTI SRDNSKNTLY LQMNSLRAED TAVYYCARGG LLLWFRRLKS NYFDYWGQGT   120
LVTVSSASTK GPSVFPLAPS SKS                                          143

X69-F09 LC (SEQ ID NO: 505)
QDIQMTQSPS SLSAFVGDRV TITCRASQPI DNYLNWYHQK PGKAPKLLIY AASRLQSGVP    60
SRLSGSGFGT DFTLTISSLQ PEDFGNYYCQ QSYTVPYTFG GGTKVEIR                108

X69-F09 HC (SEQ ID NO: 506)
EVQLLESGGG LVQPGGSLRL SCAASGFTFS AYSMIWVRQA PSKGLEWVSY IRPSGGRTTY    60
ADSVKGRFTI SRDNSKNTLY LQMNSLRAED TAVYYCARGG LLLWFRSLKS NYFDYWGQGT   120
LVTVSSASTK GPSVFPLAPS SKS                                          143

X69-F01 LC (SEQ ID NO: 507)
QDIQMTQSPS SLSAFVGDRV TITCRASQPI DNYLNWYHQK PGKAPKLLIY AASRLQSGVP    60
SRLSGSGFGT DFTLTISSLQ PEDFGNYYCQ QSYTVPYTFG GGTKVEIR                108

X69-F01 HC (SEQ ID NO: 508)
EVQLLESGGG LVQPGGSLRL SCAASGFTFS AYSMIWVRQA PSKGLEWVSY IRPSGGRTTY    60
ADSVKGRFTI SRDNSKNTLY LQMNSLRAED TAVYYCARGG LLLWFRTLKS NYFDYWGQGT   120
LVTVSSASTK GPSVFPLAPS SKS                                          143

X69-C12 LC (SEQ ID NO: 509)
QDIQMTQSPS SLSAFVGDRV TITCRASQPI DNYLNWYHQK PGKAPKLLIY AASRLQSGVP    60
SRLSGSGFGT DFTLTISSLQ PEDFGNYYCQ QSYTVPYTFG GGTKVEIR                108

X69-C12 HC (SEQ ID NO: 510)
EVQLLESGGG LVQPGGSLRL SCAASGFTFS AYSMIWVRQA PGKGLEWVSY IRPSGGRTTY    60
ADSVKGRFTI SRDNSKNTLY LQMNSLRAED TAVYYCARGG LLLWFRVLKS NYFDYWGQGT   120
LVTVSSASTK GPSVFPLAPS SKS                                          143

X69-E01 LC (SEQ ID NO: 511)
QDIQMTQSPS SLSAFVGDRV TITCRASQPI DNYLNWYHQK PGKAPKLLIY AASRLQSGVP    60
SRLSGSGFGT DFTLTISSLQ PEDFGNYYCQ QSYTVPYTFG GGTKVEIR                108

X69-E01 HC (SEQ ID NO: 512)
EVQLLESGGG LVQPGGSLRL SCAASGFTFS AYSMIWVRQA PGKGLEWVSY IRPSGGRTTY    60
ADSVKGRFTI SRDNSKNTLY LQMNSLRAED TAVYYCARGG LLLWFRWLKS NYFDYWGQGT   120
LVTVSSASTK GPSVFPLAPS SKS                                          143

X69-H10 LC (SEQ ID NO: 513)
QDIQMTQSPS SLSAFVGDRV TITCRASQPI DNYLNWYHQK PGKAPKLLIY AASRLQSGVP    60
SRLSGSGFGT DFTLTISSLQ PEDFGNYYCQ QSYTVPYTFG GGTKVEIR                108

X69-H10 HC (SEQ ID NO: 514)
EVQLLESGGG LVQPGGSLRL SCAASGFTFS AYSMIWVRQA PGKGLEWVSY IRPSGGRTTY    60
ADSVKGRFTI SRDNSKNTLY LQMNSLRAED TAVYYCARGG LLLWFRYLKS NYFDYWGQGT   120
LVTVSSASTK GPSVFPLAPS SKS                                          143

X66-F01 LC (SEQ ID NO: 515)
QDIQMTQSPS SLSAFVGDRV TITCRASQPI DNYLNWYHQK PGKAPKLLIY AASRLQSGVP    60
SRLSGSGFGT DFTLTISSLQ PEDFGNYYCQ QSYTVPYTFG GGTKVEIR                108

X66-F01 HC (SEQ ID NO: 516)
EVQLLESGGG LVQPGGSLRL SCAASGFTFS AYSMIWVRQA PGKGLEWVSY IRPSGGRTTY    60
ADSVKGRFTI SRDNSKNTLY LQMNSLRAED TAVYYCARGG LLLWFSELKS NYFDYWGQGT   120
LVTVSSASTK GPSVFPLAPS SKS                                          143

X66-H11 LC (SEQ ID NO: 517)
QDIQMTQSPS SLSAFVGDRV TITCRASQPI DNYLNWYHQK PGKAPKLLIY AASRLQSGVP    60
SRLSGSGFGT DFTLTISSLQ PEDFGNYYCQ QSYTVPYTFG GGTKVEIR                108

X66-H11 HC (SEQ ID NO: 518)
EVQLLESGGG LVQPGGSLRL SCAASGFTFS AYSMIWVRQA PGKGLEWVSY IRPSGGRTTY    60
ADSVKGRFTI SRDNSKNTLY LQMNSLRAED TAVYYCARGG LLLWFTELKS NYFDYWGQGT   120
LVTVSSASTK GPSVFPLAPS SKS                                          143

X66-C02 LC (SEQ ID NO: 519)
QDIQMTQSPS SLSAFVGDRV TITCRASQPI DNYLNWYHQK PGKAPKLLIY AASRLQSGVP    60
SRLSGSGFGT DFTLTISSLQ PEDFGNYYCQ QSYTVPYTFG GGTKVEIR                108

X66-C02 HC (SEQ ID NO: 520)
EVQLLESGGG LVQPGGSLRL SCAASGFTFS AYSMIWVRQA PGKGLEWVSY IRPSGGRTTY    60
ADSVKGRFTI SRDNSKNTLY LQMNSLRAED TAVYYCARGG LLLWFVELKS NYFDYWGQGT   120
LVTVSSASTK GPSVFPLAPS SKS                                          143

X66-F09 LC (SEQ ID NO: 521)
QDIQMTQSPS SLSAFVGDRV TITCRASQPI DNYLNWYHQK PGKAPKLLIY AASRLQSGVP    60
SRLSGSGFGT DFTLTISSLQ PEDFGNYYCQ QSYTVPYTFG GGTKVEIR                108
```

-continued

```
X66-F09 HC (SEQ ID NO: 522)
EVQLLESGGG LVQPGGSLRL SCAASGFTFS AYSMIWVRQA PGKGLEWVSY IRPSGGRTTY    60
ADSVKGRFTI SRDNSKNTLY LQMNSLRAED TAVYYCARGG LLLWFWELKS NYFDYWGQGT   120
LVTVSSASTK GPSVFPLAPS SKS                                          143

X66-G08 LC (SEQ ID NO: 523)
QDIQMTQSPS SLSAFVGDRV TITCRASQPI DNYLNWYHQK PGKAPKLLIY AASRLQSGVP    60
SRLSGSGFGT DFTLTISSLQ PEDFGNYYCQ QSYTVPYTFG GGTKVEIR                108

X66-G08 HC (SEQ ID NO: 524)
EVQLLESGGG LVQPGGSLRL SCAASGFTFS AYSMIWVRQA PGKGLEWVSY IRPSGGRTTY    60
ADSVKGRFTI SRDNSKNTLY LQMNSLRAED TAVYYCARGG LLLWFYELKS NYFDYWGQGT   120
LVTVSSASTK GPSVFPLAPS SKS                                          143

X67-C09 LC (SEQ ID NO: 525)
QDIQMTQSPS SLSAFVGDRV TITCRASQPI DNYLNWYHQK PGKAPKLLIY AASRLQSGVP    60
SRLSGSGFGT DFTLTISSLQ PEDFGNYYCQ QSYTVPYTFG GGTKVEIR                108

X67-C09 HC (SEQ ID NO: 526)
EVQLLESGGG LVQPGGSLRL SCAASGFTFS AYSMIWVRQA PGKGLEWVSY IRPSGGRTTY    60
ADSVKGRFTI SRDNSKNTLY LQMNSLRAED TAVYYCARGG LLLWGRELKS NYFDYWGQGT   120
LVTVSSASTK GPSVFPLAPS SKS                                          143

X67-B04 LC (SEQ ID NO: 527)
QDIQMTQSPS SLSAFVGDRV TITCRASQPI DNYLNWYHQK PGKAPKLLIY AASRLQSGVP    60
SRLSGSGFGT DFTLTISSLQ PEDFGNYYCQ QSYTVPYTFG GGTKVEIR                108

X67-B04 HC (SEQ ID NO: 528)
EVQLLESGGG LVQPGGSLRL SCAASGFTFS AYSMIWVRQA PGKGLEWVSY IRPSGGRTTY    60
ADSVKGRFTI SRDNSKNTLY LQMNSLRAED TAVYYCARGG LLLWKRELKS NYFDYWGQGT   120
LVTVSSASTK GPSVFPLAPS SKS                                          143

X67-G09 LC (SEQ ID NO: 529)
QDIQMTQSPS SLSAFVGDRV TITCRASQPI DNYLNWYHQK PGKAPKLLIY AASRLQSGVP    60
SRLSGSGFGT DFTLTISSLQ PEDFGNYYCQ QSYTVPYTFG GGTKVEIR                108

X67-G09 HC (SEQ ID NO: 530)
EVQLLESGGG LVQPGGSLRL SCAASGFTFS AYSMIWVRQA PGKGLEWVSY IRPSGGRTTY    60
ADSVKGRFTI SRDNSKNTLY LQMNSLRAED TAVYYCARGG LLLWLRELKS NYFDYWGQGT   120
LVTVSSASTK GPSVFPLAPS SKS                                          143

X67-C03 LC (SEQ ID NO: 531)
QDIQMTQSPS SLSAFVGDRV TITCRASQPI DNYLNWYHQK PGKAPKLLIY AASRLQSGVP    60
SRLSGSGFGT DFTLTISSLQ PEDFGNYYCQ QSYTVPYTFG GGTKVEIR                108

X67-C03 HC (SEQ ID NO: 532)
EVQLLESGGG LVQPGGSLRL SCAASGFTFS AYSMIWVRQA PGKGLEWVSY IRPSGGRTTY    60
ADSVKGRFTI SRDNSKNTLY LQMNSLRAED TAVYYCARGG LLLWMRELKS NYFDYWGQGT   120
LVTVSSASTK GPSVFPLAPS SKS                                          143

X67-D03 LC (SEQ ID NO: 533)
QDIQMTQSPS SLSAFVGDRV TITCRASQPI DNYLNWYHQK PGKAPKLLIY AASRLQSGVP    60
SRLSGSGFGT DFTLTISSLQ PEDFGNYYCQ QSYTVPYTFG GGTKVEIR                108

X67-D03 HC (SEQ ID NO: 534)
EVQLLESGGG LVQPGGSLRL SCAASGFTFS AYSMIWVRQA PGKGLEWVSY IRPSGGRTTY    60
ADSVKGRFTI SRDNSKNTLY LQMNSLRAED TAVYYCARGG LLLWNRELKS NYFDYWGQGT   120
LVTVSSASTK GPSVFPLAPS SKS                                          143

X67-B05 LC (SEQ ID NO: 535)
QDIQMTQSPS SLSAFVGDRV TITCRASQPI DNYLNWYHQK PGKAPKLLIY AASRLQSGVP    60
SRLSGSGFGT DFTLTISSLQ PEDFGNYYCQ QSYTVPYTFG GGTKVEIR                108

X67-B05 HC (SEQ ID NO: 536)
EVQLLESGGG LVQPGGSLRL SCAASGFTFS AYSMIWVRQA PGKGLEWVSY IRPSGGRTTY    60
ADSVKGRFTI SRDNSKNTLY LQMNSLRAED TAVYYCARGG LLLWPRELKS NYFDYWGQGT   120
LVTVSSASTK GPSVFPLAPS SKS                                          143

X67-F01 LC (SEQ ID NO: 537)
QDIQMTQSPS SLSAFVGDRV TITCRASQPI DNYLNWYHQK PGKAPKLLIY AASRLQSGVP    60
SRLSGSGFGT DFTLTISSLQ PEDFGNYYCQ QSYTVPYTFG GGTKVEIR                108

X67-F01 HC (SEQ ID NO: 538)
EVQLLESGGG LVQPGGSLRL SCAASGFTFS AYSMIWVRQA PGKGLEWVSY IRPSGGRTTY    60
ADSVKGRFTI SRDNSKNTLY LQMNSLRAED TAVYYCARGG LLLWQRELKS NYFDYWGQGT   120
LVTVSSASTK GPSVFPLAPS SKS                                          143

X67-G05 LC (SEQ ID NO: 539)
QDIQMTQSPS SLSAFVGDRV TITCRASQPI DNYLNWYHQK PGKAPKLLIY AASRLQSGVP    60
SRLSGSGFGT DFTLTISSLQ PEDFGNYYCQ QSYTVPYTFG GGTKVEIR                108
```

-continued

```
X67-G05 HC (SEQ ID NO: 540)
EVQLLESGGG LVQPGGSLRL SCAASGFTFS AYSMIWVRQA PGKGLEWVSY IRPSGGRTTY   60
ADSVKGRFTI SRDNSKNTLY LQMNSLRAED TAVYYCARGG LLLWRRELKS NYFDYWGQGT  120
LVTVSSASTK GPSVFPLAPS SKS                                         143

X67-B03 LC (SEQ ID NO: 541)
QDIQMTQSPS SLSAFVGDRV TITCRASQPI DNYLNWYHQK PGKAPKLLIY AASRLQSGVP   60
SRLSGSGFGT DFTLTISSLQ PEDFGNYYCQ QSYTVPYTFG GGTKVEIR              108

X67-B03 HC (SEQ ID NO: 542)
EVQLLESGGG LVQPGGSLRL SCAASGFTFS AYSMIWVRQA PGKGLEWVSY IRPSGGRTTY   60
ADSVKGRFTI SRDNSKNTLY LQMNSLRAED TAVYYCARGG LLLWSRELKS NYFDYWGQGT  120
LVTVSSASTK GPSVFPLAPS SKS                                         143

X67-F10 LC (SEQ ID NO: 543)
QDIQMTQSPS SLSAFVGDRV TITCRASQPI DNYLNWYHQK PGKAPKLLIY AASRLQSGVP   60
SRLSGSGFGT DFTLTISSLQ PEDFGNYYCQ QSYTVPYTFG GGTKVEIR              108

X67-F10 HC (SEQ ID NO: 544)
EVQLLESGGG LVQPGGSLRL SCAASGFTFS AYSMIWVRQA PGKGLEWVSY IRPSGGRTTY   60
ADSVKGRFTI SRDNSKNTLY LQMNSLRAED TAVYYCARGG LLLWTRELKS NYFDYWGQGT  120
LVTVSSASTK GPSVFPLAPS SKS                                         143

X67-H01 LC (SEQ ID NO: 545)
QDIQMTQSPS SLSAFVGDRV TITCRASQPI DNYLNWYHQK PGKAPKLLIY AASRLQSGVP   60
SRLSGSGFGT DFTLTISSLQ PEDFGNYYCQ QSYTVPYTFG GGTKVEIR              108

X67-H01 HC (SEQ ID NO: 546)
EVQLLESGGG LVQPGGSLRL SCAASGFTFS AYSMIWVRQA PGKGLEWVSY IRPSGGRTTY   60
ADSVKGRFTI SRDNSKNTLY LQMNSLRAED TAVYYCARGG LLLWWRELKS NYFDYWGQGT  120
LVTVSSASTK GPSVFPLAPS SKS                                         143

X67-F08 LC (SEQ ID NO: 547)
QDIQMTQSPS SLSAFVGDRV TITCRASQPI DNYLNWYHQK PGKAPKLLIY AASRLQSGVP   60
SRLSGSGFGT DFTLTISSLQ PEDFGNYYCQ QSYTVPYTFG GGTKVEIR              108

X67-F08 HC (SEQ ID NO: 548)
EVQLLESGGG LVQPGGSLRL SCAASGFTFS AYSMIWVRQA PGKGLEWVSY IRPSGGRTTY   60
ADSVKGRFTI SRDNSKNTLY LQMNSLRAED TAVYYCARGG LLLWYRELKS NYFDYWGQGT  120
LVTVSSASTK GPSVFPLAPS SKS                                         143
```

TABLE 10

CDR Amino Acid Sequences of Optimized Antibody Inhibitor of pKal Based on M142-H08

| Initial Name | Ki, app (nM) of IgG | LV-CDR1 (SEQ ID NOS 549-550, respectively, in order of appearance) | LV-CDR2 (SEQ ID NOS 551-552, respectively, in order of appearance) | LV-CDR3 (SEQ ID NOS 553-55, respectively, in order of appearance) | HV-CDR1 (SEQ ID NOS 555-556, respectively, in order of appearance) | HV-CDR2 (SEQ ID NOS 557-558, respectively, in order of appearance) | HV-CDR3[a] (SEQ ID NOS 559-560, respectively, in order of appearance) |
|---|---|---|---|---|---|---|---|
| X67-D03 | 0.1 | RASQPIDNYLN | AASRLQS | QQSYTVPYT | AYSMI | YIRPSGGRTTYADSVKG | GGLLLWNRELKSNYFDY |
| X67-G04 | 0.35 | RASQPIDNYLN | AASRLQS | QQSYTVPYT | AYSMI | YIRPSGGRTTYADSVKG | GGLLLWARELKSNYFDY |

[a]The F to N substitution (in bold) in the CDR3 of the M142-H08 gives X67-D03, an IgG that is not cleaved during expression and is a potent inhibitor of human. Similarly, the F to A substitution gives X67-G04, which is also not cleaved.

TABLE 11

CDR Amino Acid Sequences of Affinity Matured Antibody Inhibitors of pKal Discovered using ROLIC

| Initial Name | Ki, app (nM) | LV-CDR1 (SEQ ID NOS 561-566, respectively, in order of appearance) | LV-CDR2 (SEQ ID NOS 567-572, respectively, in order of appearance) | LV-CDR3 (SEQ ID NOS 573-578, respectively, in order of appearance) | HV-CDR1 (SEQ ID NOS 579-584, respectively, in order of appearance) | HV-CDR2 (SEQ ID NOS 585-590, respectively, in order of appearance) | HV-CDR3 (SEQ ID NOS 591-596, respectively, in order of appearance) |
|---|---|---|---|---|---|---|---|
| X59-C07 | 6.1 | RAGRSISTYVN | AASSLQS | QQSQSTPYT | HYLMT | YISPSGGHTIYADSVKG | VARGIAARSRTSYFDY |
| X60-D01 | 2.0 | RASQIVSSRYLA | GAASRAT | QQTYSSPFT | HYLMT | YISPSGGHTIYADSVKG | VARGIAARSRTSYFDY |
| X63-G10 | 9.0 | RASQSISNYLN | AASSLQS | QQSYTSPYT | HYLMT | YISPSGGHTIYADSVKG | VARGIAARSRTSYFDY |
| X64-F04 | 1.9 | RASQIVSSNYLA | GASNRAT | QQSFNIPYT | HYLMT | YISPSGGHTIYADSVKG | VARGIAARSRTSYFDY |
| X63-G06 | 0.4 (Fab) | RTSQFVNSNYLA | GASSRAT | QQSSRTPWT | HYLMT | YISPSGGHTIYADSVKS | VARGIAARSRTSYFDY |
| X81-B01[a] | 0.2 (IgG) | RTSQFVNSNYLA | GASSRAT | QQSSRTPWT | HYLMT | YISPSGGHTIYADSVKG | VARGIAARSRTSYFDY |

[a] X81-B01 is the codon optimized and germlined version of X63-G06 as a full length human IgG produced in CHO cells Amino acid sequences of light chain (LC) and heavy chain (HC) variable domain of affinity matured antibody inhibitors of pKal discovered using ROLIC are shown below.

```
X59-C07 LC (SEQ ID NO: 597)
QDIQMTQSPS SLSASVSDRV TVTCRAGRSI STYVNWYQQK PGKAPKLLIY AASSLQSGVP    60
SRFSGSRSGT DFTLTISSLQ PEDFATYYCQ QSQSTPYTFG QSTKLEVK               108

X59-C07 HC (SEQ ID NO: 598)
EVQLLESGGG LVQPGGSLRL SCAASGFTFS HYLMTWVRQA PGKGLEWVSY ISPSGGHTIY    60
ADSVKGRFTI SRDNSKNTLY LQMNSLRAED TAVYYCARVA RGIAARSRTS YFDYWGQGTL  120
VTVSSASTKG PSVFPLAPSS KS                                          142

X60-D01 LC (SEQ ID NO: 599)
QDIQMTQSPG TLSLSPGERA TLSCRASQIV SSRYLAWYQQ RPGQAPRLLI YGAASRATGI    60
PDRFSGSGSG TDFTLTISSL QAEDFATYYC QQTYSSPFTF GQGTKMEIK              109

X60-D01 HC (SEQ ID NO: 600)
EVQLLESGGG LVQPGGSLRL SCAASGFTFS HYLMTWVRQA PGKGLEWVSY ISPSGGHTIY    60
ADSVKGRFTI SRDNSKNTLY LQMNSLRAED TAVYYCARVA RGIAARSRTS YFDYWGQGTL  120
VTVSSASTKG PSVFPLAPSS KS                                          142

X63-G06 LC (Fab version of X81-B01 IgG) (SEQ ID NO: 601)
QDIQMTQSPG TLSLSPGERA TLSCRTSQFV NSNYLAWYQQ TPGQAPRLLI YGASSRATGI    60
PDRFSGTGYG TDFTLTISRL EPEDYGTYYC QQSSRTPWTF GQGTRVEIK             109

X63-G06 HC (Fab version of X81-B01 IgG) (SEQ ID NO: 602)
EVQLLESGGG LVQPGGSLRL SCAASGFTFS HYLMTWVRQA PGKGLEWVSY ISPSGGHTIY    60
ADSVKGRFTI SRDNSKNTLY LQMNSLRAED TAVYYCARVA RGIAARSRTS YFDYWGQGTL  120
VTVSSASTKG PSVFPLAPSS KS                                          142

X63-G10 LC (SEQ ID NO: 603)
QDIQMTQSPD SLSASVGDRV TITCRASQSI SNYLNWYQQK PGKAPKLLIY AASSLQSGVP    60
SRFSGSGSGT DFTLTISGLQ PEDFASYYCQ QSYTSPYTFV QGTKLEIKRT            110

X63-G10 HC (SEQ ID NO: 604)
EVQLLESGGG LVQPGGSLRL SCAASGFTFS HYLMTWVRQA PGKGLEWVSY ISPSGGHTIY    60
ADSVKGRFTI SRDNSKNTLY LQMNSLRAED TAVYYCARVA RGIAARSRTS YFDYWGQGTL  120
VTVSSASTKG PSVFPLAPSS KS                                          142

X64-F04 LC (SEQ ID NO: 605)
QDIQMTQSPA TLSLSPGERA TLSCRASQIV SSNYLAWYQQ KPGQAPRLLI YGASNRATGI    60
PDRFSGSGSG TEFTLTISSL QSEDFAIYYC QQSFNIPYTF GQGTRVDIK             109

X64-F04 HC (SEQ ID NO: 606)
EVQLLESGGG LVQPGGSLRL SCAASGFTFS HYLMTWVRQA PGKGLEWVSY ISPSGGHTIY    60
```

-continued

```
ADSVKGRFTI SRDNSKNTLY LQMNSLRAED TAVYYCARVA RGIAARSRTS YFDYWGQGTL  120
VTVSSASTKG PSVFPLAPSS KS                                          142
X81-B01 is the IgG version of the X63-G06 Fab, as indicated above.
```

Example 6

Affinity Maturation

In addition to optimizing the sequence of the clipped antibody (M142-H08), we also performed affinity maturation on two of the antibodies identified by phage display (M162-A04 and M160-G12). Both of these antibodies inhibit human pKal with single digit nanomolar potency, appear specific to pKal, and do not bind prekallikrein (Table 7). We first performed a novel form of light chain shuffling called ROLIC (Rapid Optimization of Light Chains) on M162-A04 and M160-G12 (see, e.g., WO 2009/102927 and U.S. 2009-0215119). From the screening of the antibodies discovered by ROLIC we identified one antibody with subnamolar potency (X63-G06) that shared the same heavy chain as M160-G12. We then constructed HV-CDR3 spiking affinity maturation libraries based on CDR3 sequences in M162-A04 and X63-G06 (described below).

Affinity Maturation by ROLIC.

We used ROLIC to affinity mature the two leads from Table 7 that were not cleaved (M162-A04 and M160-G12). This process identified one antibody that inhibits pKal with a sub-nanomolar $K_{i,app}$ (Table 11). X63-G06 inhibits pKal with a $K_{i,app}$ of approximately 0.4 nM as a Fab fragment. When this antibody was converted to an IgG that is germlined and sequenced optimized for CHO cell expression (X81-B01) it was found to inhibit pKal with a $K_{i,app}$ of approximately 0.2 nM.

Example 7

Affinity Maturation of Heavy Chain CDR1/2 and CDR3

We used two additional affinity maturation strategies to identify highly potent antibodies based on two different parental antibody inhibitor leads: M162-A04 and X63-G06. One approach was to generate libraries that shuffled the CDR1/2 of the HC of two different parental antibody inhibitor leads (M162-A04 and X63-G06) against additional CDR1/2 diversity. Another approach was to create heavy chain CDR3 spiking libraries based on these leads.

The 82 antibodies that were discovered based on improvements in M162-A04 due to modifications in either the CDR1/2 and CDR3 region are shown in Table 12. Inhibition screening with 10 nM antibody (as Fab fragments) revealed that there were 33 antibodies that inhibited pKal activity by over 90%. Several antibodies were shown to be subnanomolar inhibitors of human pKal.

The 62 antibodies that were discovered based on improvements in X63-G06 due to modifications in either the CDR1/2 and CDR3 region are shown in Table 13. Inhibition screening with 10 nM antibody (as Fab fragments) revealed that there were 24 antibodies that inhibited pKal activity by over 90%. Several antibodies were shown to be subnanomolar inhibitors of human pKal.

TABLE 12

Sequences of Antibodies Obtained from CDR1/2 and CDR3 Spiking Affinity Maturation Libraries Based on M162-A04

| Antibody I.D. | % inhibition at 10 nM | human pKal Ki, app (nM) | LV-CDR1 (SEQ ID NOS 607-688, respectively, in order of appearance) | LV-CDR2 (SEQ ID NOS 689-770, respectively, in order of appearance) | LV-CDR3 (SEQ ID NOS 771-852, respectively, in order of appearance) | HV-CDR1 (SEQ ID NOS 853-934, respectively, in order of appearance) | HV-CDR2 (SEQ ID NOS 935-1016, respectively, in order of appearance) | HV-CDR3 (SEQ ID NOS 1017-1098, respectively, in order of appearance) |
|---|---|---|---|---|---|---|---|---|
| M202-A12 | 97.5 | 0.2 | RASQSISSWLA | KASTLES | QQYNTYWT | HYIMM | GIYSSGGITVYADSVKG | QRTGVPRRDSFNI |
| M196-C06 | 97.2 | 0.1 | RASQSISSWLA | KASTLES | QQYNTYWT | IYSMH | SIYPSRGMTWYADSVKG | RRTGIPRRDAFDI |
| M198-F09 | 96.9 | 0.2 | RASQSISSWLA | KASTLES | QQYNTYWT | VYNMH | SIYPSGGMTYYADSVKG | RRTGIPRRDAFDI |
| M199-A08 | 96.4 | 0.06 | RASQSISSWLA | KASTLES | QQYNTYWT | HYIMM | GIYSSGGITVYADSVKG | RRIGVPRRDEFDI |
| M202-C01 | 96.3 | 0.1 | RASQSISSWLA | KASTLES | QQYNTYWT | HYIMM | GIYSSGGITVYADSVKG | RRTGVPRWDDFDI |
| M198-A06 | 96.1 | 0.4 | RASQSISSWLA | KASTLES | QQYNTYWT | IYSMH | SIYSSGGPTKYADSVKG | RRTGIPRRDAFDI |
| M200-D03 | 95.9 | 0.1 | RASQSISSWLA | KASTLES | QQYNTYWT | HYIMM | GIYSSGGITVYADSVKG | RRIGVPRRDSFDM |
| M202-H03 | 95.7 | 0.1 | RASQSISSWLA | KASTLES | QQYNTYWT | HYIMM | GIYSSGGITVYADSVKG | RRTGVPRWDDFDI |

TABLE 12-continued

Sequences of Antibodies Obtained from CDR1/2 and CDR3 Spiking Affinity Maturation Libraries Based on M162-A04

| Antibody I.D. | % inhibition at 10 nM | human pKal Ki, app (nM) | LV-CDR1 (SEQ ID NOS 607-688, respectively, in order of appearance) | LV-CDR2 (SEQ ID NOS 689-770, respectively, in order of appearance) | LV-CDR3 (SEQ ID NOS 771-852, respectively, in order of appearance) | HV-CDR1 (SEQ ID NOS 853-934, respectively, in order of appearance) | HV-CDR2 (SEQ ID NOS 935-1016, respectively, in order of appearance) | HV-CDR3 (SEQ ID NOS 1017-1098, respectively, in order of appearance) |
|---|---|---|---|---|---|---|---|---|
| M201-A07 | 95.7 | 0.1 | RASQSISSWLA | KASTLES | QQYNTYWT | HYIMM | GIYSSGGITVYADSVKG | RRTGVPRRDEFDI |
| M197-A01 | 95.3 | | RASQSISSWLA | KASTLES | QQYNTYWT | IYDMI | SIYPSGGNTSYADSVKG | RRTGIPRRDAFDI |
| M202-D09 | 95.0 | 0.4 | RASQSISSWLA | KASTLES | QQYNTYWT | HYIMM | GIYSSGGITVYADSVKG | RRIGVPRRDSFDI |
| M197-A09 | 94.9 | 0.6 | RASQSISSWLA | KASTLES | QQYNTYWT | VYNMH | SIYPSGGMTTYADSVKG | RRTGIPRRDAFDI |
| M198-G07 | 94.9 | | RASQSISSWLA | KASTLES | QQYNTYWT | IYDMT | SIYPSGGQTIYADSVKG | RRTGIPRRDAFDI |
| M200-A10 | 94.3 | 0.3 | RASQSISSWLA | KASTLES | QQYNTYWT | HYIMM | GIYSSGGITVYADSVKG | RRTGVPRRDSFDI |
| M197-H10 | 94.1 | | RASQSISSWLA | KASTLES | QQYNTYWT | SYNMH | SIVPSGGKTNYADSVKG | RRTGIPRRDAFDI |
| M196-D12 | 94.1 | 0.2 | RASQSISSWLA | KASTLES | QQYNTYWT | RYSMR | VIYPSGGQTYYADSVKG | RRTGIPRRDAFDI |
| M197-A08 | 93.7 | | RASQSISSWLA | KASTLES | QQYNTYWT | IYSMQ | SIGSSGGKTLYADSVKG | RRTGIPRRDAFDI |
| M198-B09 | 93.5 | | RASQSISSWLA | KASTLES | QQYNTYWT | VYSMT | SIGSSGGSTTYADSVKG | RRTGIPRRDAFDI |
| M198-E09 | 93.1 | | RASQSISSWLA | KASTLES | QQYNTYWT | IYDMN | SIYPSGGRTRYADSVKG | RRTGIPRRDAFDI |
| M202-B03 | 93.1 | 0.3 | RASQSISSWLA | KASTLES | QQYNTYWT | HYIMM | GIYSSGGITVYADSVKG | RRTGVPRRDDFDI |
| M198-C10 | 93.0 | | RASQSISSWLA | KASTLES | QQYNTYWT | HYMGMN | SIVPSGGWTQYADSVKG | RRTGIPRRDAFDI |
| M197-E12 | 93.0 | | RASQSISSWLA | KASTLES | QQYNTYWT | TYTMR | SIYPSGGKTQYADSVKG | RRTGIPRRDAFDI |
| M198-F04 | 92.9 | | RASQSISSWLA | KASTLES | QQYNTYWT | IYDMW | SIRPSGGITKYADSVKG | RRTGIPRRDAFDI |
| M197-H11 | 92.9 | | RASQSISSWLA | KASTLES | QQYNTYWT | IYNMI | SIYPSGGWTTYADSVKG | RRTGIPRRDAFDI |
| M197-F01 | 92.6 | | RASQSISSWLA | KASTLES | QQYNTYWT | IYHMY | SIGPSGGPTGYADSVKG | RRTGIPRRDAFDI |
| M198-E11 | 92.5 | | RASQSISSWLA | KASTLES | QQYNTYWT | TYSMY | SIYPSGGLTWYADSVKG | RRTGIPRRDAFDI |
| M202-C09 | 92.3 | 0.3 | RASQSISSWLA | KASTLES | QQYNTYWT | HYIMM | GIYSSGGITVYADSVKG | RRIGVPRRDDFDI |
| M198-H08 | 92.3 | | RASQSISSWLA | KASTLES | QQYNTYWT | IYDMY | SIGPSGGPTAYADSVKG | RRTGIPRRDAFDI |
| M198-F08 | 91.8 | | RASQSISSWLA | KASTLES | QQYNTYWT | VYSMW | SISSSGGMTEYADSVKG | RRTGIPRRDAFDI |
| M202-E06 | 91.5 | | RASQSISSWLA | KASTLES | QQYNTYWT | HYIMM | GIYSSGGITVYADSVKG | RRRGVPRRDDFDI |

TABLE 12-continued

Sequences of Antibodies Obtained from CDR1/2 and CDR3 Spiking Affinity Maturation Libraries Based on M162-A04

| Antibody I.D. | % inhibition at 10 nM | human pKal Ki, app (nM) | LV-CDR1 (SEQ ID NOS 607-688, respectively, in order of appearance) | LV-CDR2 (SEQ ID NOS 689-770, respectively, in order of appearance) | LV-CDR3 (SEQ ID NOS 771-852, respectively, in order of appearance) | HV-CDR1 (SEQ ID NOS 853-934, respectively, in order of appearance) | HV-CDR2 (SEQ ID NOS 935-1016, respectively, in order of appearance) | HV-CDR3 (SEQ ID NOS 1017-1098, respectively, in order of appearance) |
|---|---|---|---|---|---|---|---|---|
| M195-D12 | 90.8 | | RASQSISSWLA | KASTLES | QQYNTYWT | IYGMF | GIGPSGGPTKYADSVKG | RRTGIPRRDAFDI |
| M197-F03 | 90.7 | | RASQSISSWLA | KASTLES | QQYNTYWT | IYSMF | SIGPSGGVTHYADSVKG | RRTGIPRRDAFDI |
| M198-E02 | 90.3 | | RASQSISSWLA | KASTLES | QQYNTYWT | IYSMY | YIRPSGGNTKYADSVKG | RRTGIPRRDAFDI |
| M198-A02 | 89.1 | | RASQSISSWLA | KASTLES | QQYNTYWT | RYSMI | SIWSSGGATEYADSVKG | RRTGIPRRDAFDI |
| M202-A01 | 88.9 | | RASQSISSWLA | KASTLES | QQYNTYWT | HYIMM | GIYSSGGITVYADSVKG | RRIGVPRRDAFDI |
| M202-G03 | 88.3 | | RASQSISSWLA | KASTLES | QQYNTYWT | HYIMM | GIYSSGGITVYADSVKG | RRTGVPRRDSFEI |
| M195-B12 | 87.7 | | RASQSISSWLA | KASTLES | QQYNTYWT | KYWMY | YIRPSGGQTYYADSVKG | RRTGIPRRDAFDI |
| M198-A07 | 86.1 | | RASQSISSWLA | KASTLES | QQYNTYWT | RYQMH | WISPSGGITGYADSVKG | RRTGIPRRDAFDI |
| M198-H02 | 85.8 | | RASQSISSWLA | KASTLES | QQYNTYWT | PYNMY | WIVPGGVTKYADSVKG | RRTGIPRRDAFDI |
| M200-H07 | 85.4 | | RASQSISSWLA | KASTLES | QQYNTYWT | HYIMM | GIYSSGGITVYADSVKG | RRTGVPRRNAFDN |
| M201-H06 | 84.6 | | RASQSISSWLA | KASTLES | QQYNTYWT | HYIMM | GIYSSGGITVYADSVKG | RRTGVPRRDAFDI |
| M202-F06 | 84.2 | | RASQSISSWLA | KASTLES | QQYNTYWT | HYIMM | GIYSSGGITVYADSVKG | RRTGVPRWDAFDI |
| M195-C12 | 84.2 | | RASQSISSWLA | KASTLES | QQYNTYWT | MYQMF | SISPGGGTQYADSVKG | RRTGIPRRDAFDI |
| M202-H05 | 84.0 | | RASQSISSWLA | KASTLES | QQYNTYWT | HYIMM | GIYSSGGITVYADSVKG | RRTGVPRRDVFDI |
| M198-C05 | 83.9 | | RASQSISSWLA | KASTLES | QQYNTYWT | RYKMY | VIGPSGGATFYADSVKG | RRTGIPRRDAFDI |
| M196-H03 | 83.9 | | RASQSISSWLA | KASTLES | QQYNTYWT | RYVMW | SISPSGDTHYADSVKG | RRTGIPRRDAFDI |
| M200-E11 | 83.2 | | RASQSISSWLA | KASTLES | QQYNTYWT | HYIMM | GIYSSGGITVYADSVKG | RRTGVPRRDAFDN |
| M202-B04 | 81.9 | | RASQSISSWLA | KASTLES | QQYNTYWT | HYIMM | GIYSSGGITVYADSVKG | RRSGVPRRDDFDI |
| M202-A04 | 81.2 | | RASQSISSWLA | KASTLES | QQYNTYWT | HYIMM | GIYSSGGITVYADSVKG | RRKGIPRRDDFDI |
| M198-B12 | 80.7 | | RASQSISSWLA | KASTLES | QQYNTYWT | KYSMA | GIYPSGGRTLYADSVKG | RRTGIPRRDAFDI |
| M198-A09 | 77.3 | | RASQSISSWLA | KASTLES | QQYNTYWT | IYFMS | SIRSSGGPTWYADSVKG | RRTGIPRRDAFDI |
| M198-C06 | 76.5 | | RASQSISSWLA | KASTLES | QQYNTYWT | QYFMH | YIYPSGGMTEYADSVKG | RRTGIPRRDAFDI |

TABLE 12-continued

Sequences of Antibodies Obtained from CDR1/2 and CDR3 Spiking Affinity Maturation Libraries Based on M162-A04

| Antibody I.D. | % inhibition at 10 nM | human pKal Ki, app (nM) | LV-CDR1 (SEQ ID NOS 607-688, respectively, in order of appearance) | LV-CDR2 (SEQ ID NOS 689-770, respectively, in order of appearance) | LV-CDR3 (SEQ ID NOS 771-852, respectively, in order of appearance) | HV-CDR1 (SEQ ID NOS 853-934, respectively, in order of appearance) | HV-CDR2 (SEQ ID NOS 935-1016, respectively, in order of appearance) | HV-CDR3 (SEQ ID NOS 1017-1098, respectively, in order of appearance) |
|---|---|---|---|---|---|---|---|---|
| M198-C09 | 75.4 | | RASQSISSWLA | KASTLES | QQYNTYWT | IYTMY | SISPSGGWTYYADSVKG | RRTGIPRRDAFDI |
| M195-B02 | 75.1 | | RASQSISSWLA | KASTLES | QQYNTYWT | PYLMW | YIGPSGGPTHYADSVKG | RRTGIPRRDAFDI |
| M198-F12 | 74.6 | | RASQSISSWLA | KASTLES | QQYNTYWT | IYTMM | SIWSSGGQTKYADSVKG | RRTGIPRRDAFDI |
| M201-H08 | 74.5 | | RASQSISSWLA | KASTLES | QQYNTYWT | HYIMM | GIYSSGGITVYADSVKG | RRTGVPRRDALDN |
| M202-C02 | 74.3 | | RASQSISSWLA | KASTLES | QQYNTYWT | HYIMM | GIYSSGGITVYADSVKG | RRPGVPRRDAFDI |
| M198-C03 | 72.4 | | RASQSISSWLA | KASTLES | QQYNTYWT | RYSMS | GISPSGGETSYADSVKG | RRTGIPRRDAFDI |
| M198-A08 | 72.3 | | RASQSISSWLA | KASTLES | QQYNTYWT | WYMMQ | RISPSGGTTYADSVKG | RRTGIPRRDAFDI |
| M195-A02 | 71.3 | | RASQSISSWLA | KASTLES | QQYNTYWT | QYMMM | GISSSGGHTDYADSVKG | RRTGIPRRDAFDI |
| M197-G10 | 67.6 | | RASQSISSWLA | KASTLES | QQYNTYWT | VYAMR | SIYPSGGKTWYADSVKG | RRTGIPRRDAFDI |
| M195-G02 | 67.5 | | RASQSISSWLA | KASTLES | QQYNTYWT | PYNMM | SIWPSGGTTDYADSVKG | RRTGIPRRDAFDI |
| M196-D02 | 66.2 | | RASQSISSWLA | KASTLES | QQYNTYWT | VYSMH | VIGPSGGITLYADSVKG | RRTGIPRRDAFDI |
| M199-A11 | 65.4 | | RASQSISSWLA | KASTLES | QQYNTYWT | HYIMM | GIYSSGGITVYADSVKG | RRRGIPRRDAFDI |
| M200-F01 | 65.1 | | RASQSISSWLA | KASTLES | QQYNTYWT | HYIMM | GIYSSGGITVYADSVKG | RRMGIPRRNAFDI |
| M198-D12 | 63.5 | 0.7 | RASQSISSWLA | KASTLES | QQYNTYWT | LYVMY | YIVPSGGPTAYADSVKG | RRTGIPRRDAFDI |
| M197-C12 | 56.4 | | RASQSISSWLA | KASTLES | QQYNTYWT | PYDML | YIVSSGGLTKYADSVKG | RRTGIPRRDAFDI |
| M198-G03 | 53.8 | | RASQSISSWLA | KASTLES | QQYNTYWT | QYTMV | WIYSSRANYADSVKG | RRTGIPRRDAFDI |
| M199-B01 | 53.4 | | RASQSISSWLA | KASTLES | QQYNTYWT | HYIMM | GIYSSGGITVYADSVKG | RRTGIPRRDAFDN |
| M202-A08 | 52.9 | | RASQSISSWLA | KASTLES | QQYNTYWT | HYIMM | GIYSSGGITVYADSVKG | RRTGIPRWDAFDI |
| M195-A12 | 51.7 | | RASQSISSWLA | KASTLES | QQYNTYWT | PYMMM | GIYPSGGYTVYADSVKG | RRTGIPRRDAFDI |
| M202-E03 | 51.4 | | RASQSISSWLA | KASTLES | QQYNTYWT | HYIMM | GIYSSGGITVYADSVKG | RRTGIPRRDAFEI |
| M196-G12 | 51.1 | | RASQSISSWLA | KASTLES | QQYNTYWT | NYSMD | RIYSSGGGTIYADSVKG | RRTGIPRRDAFDI |
| M195-F12 | 45.5 | | RASQSISSWLA | KASTLES | QQYNTYWT | HYVMM | YIVPSGGVTAYADSVKG | RRTGIPRRDAFDI |

TABLE 12-continued

Sequences of Antibodies Obtained from CDR1/2 and CDR3 Spiking Affinity Maturation Libraries Based on M162-A04

| Antibody I.D. | % inhibition at 10 nM | human pKal Ki, app (nM) | LV-CDR1 (SEQ ID NOS 607-688, respectively, in order of appearance) | LV-CDR2 (SEQ ID NOS 689-770, respectively, in order of appearance) | LV-CDR3 (SEQ ID NOS 771-852, respectively, in order of appearance) | HV-CDR1 (SEQ ID NOS 853-934, respectively, in order of appearance) | HV-CDR2 (SEQ ID NOS 935-1016, respectively, in order of appearance) | HV-CDR3 (SEQ ID NOS 1017-1098, respectively, in order of appearance) |
|---|---|---|---|---|---|---|---|---|
| M200-B01 | 42.6 | | RASQSISSWLA | KASTLES | QQYNTYWT | HYIMM | GIYSSGGITVYADSVKG | RRTGIPRRDAFDS |
| M198-H09 | 41.1 | | RASQSISSWLA | KASTLES | QQYNTYWT | IYLMI | YIGPSGGPTEYADSVKG | RRTGIPRRDAFDI |
| M195-E12 | 38.0 | | RASQSISSWLA | KASTLES | QQYNTYWT | YYIMF | YISPSGGYTHYADSVKG | RRTGIPRRDAFDI |
| M201-A06 | 36.8 | | RASQSISSWLA | KASTLES | QQYNTYWT | HYIMM | GIYSSGGITVYADSVKG | RRTGIPRRDVFDI |
| M202-A10 | 36.3 | | RASQSISSWLA | KASTLES | QQYNTYWT | HYIMM | GIYSSGGITVYADSVKG | RRTGIPRRDSFDI |
| M197-G11 | 19.2 | | RASQSISSWLA | KASTLES | QQYNTYWT | TYAMV | SIYPSGGITTYADSVKG | RRTGIPRRDAFDI |
| M201-F11 | 15.7 | | RASQSISSWLA | KASTLES | QQYNTYWT | HYIMM | GIYSSGGITVYADSVKG | RRSGIPRRDAFDI |
| M198-A01 | 13.8 | | RASQSISSWLA | KASTLES | QQYNTYWT | PYTMI | SISSSGGMTPYADSVKG | RRTGIPRRDAFDI |

Amino acid sequences of light chain (LC) and heavy chain (HC) variable domain of pKal antibodies obtained from CDR1/2 and CDR3 spiking affinity maturation libraries based on M162-A04.

```
M195-A02 LC (SEQ ID NO: 1099)
QDIQMTQSPS TLSASVGDRV TITCRASQSI SSWLAWYQQK PGKAPNLLIY KASTLESGVP    60
SRFSGSGSGT EFTLTISSLQ PDDFATYYCQ QYNTYWTFGQ GTKVEIK                107

M195-A02 HC (SEQ ID NO: 1100)
EVQLLESGGG LVQPGGSLRL SCAASGFTFS QYMMMWVRQA PGKGLEWVSG ISSSGGHTDY    60
ADSVKGRFTI SRDNSKNTLY LQMNSLRAED TAVYYCAYRR TGIPRRDAFD IWGQGTMVTV   120
SSASTKGPSV FPLAPSSKS                                                139

M195-A12 LC (SEQ ID NO: 1101)
QDIQMTQSPS TLSASVGDRV TITCRASQSI SSWLAWYQQK PGKAPNLLIY KASTLESGVP    60
SRFSGSGSGT EFTLTISSLQ PDDFATYYCQ QYNTYWTFGQ GTKVEIK                107

M195-A12 HC (SEQ ID NO: 1102)
EVQLLESGGG LVQPGGSLRL SCAASGFTFS PYMMMWVRQA PGKGLEWVSG IYPSGGYTVY    60
ADSVKGRFTI SRDNSKNTLY LQMNSLRAED TAVYYCAYRR TGIPRRDAFD IWGQGTMVTV   120
SSASTKGPSV FPLAPSSKS                                                139

M195-B02 LC (SEQ ID NO: 1103)
QDIQMTQSPS TLSASVGDRV TITCRASQSI SSWLAWYQQK PGKAPNLLIY KASTLESGVP    60
SRFSGSGSGT EFTLTISSLQ PDDFATYYCQ QYNTYWTFGQ GTKVEIK                107

M195-B02 HC (SEQ ID NO: 1104)
EVQLLESGGG LVQPGGSLRL SCAASGFTFS PYLMWWVRQA PGKGLEWVSY IGPSGGPTHY    60
ADSVKGRFTI SRDNSKNTLY LQMNSLRAED TAVYYCAYRR TGIPRRDAFD IWGQGTMVTV   120
SSASTKGPSV FPLAPSSKS                                                139

M195-B12 LC (SEQ ID NO: 1105)
QDIQMTQSPS TLSASVGDRV TITCRASQSI SSWLAWYQQK PGKAPNLLIY KASTLESGVP    60
SRFSGSGSGT EFTLTISSLQ PDDFATYYCQ QYNTYWTFGQ GTKVEIK                107
```

```
M195-B12 HC (SEQ ID NO: 1106)
EVQLLESGGG LVQPGGSLRL SCAASGFTFS KYWMYWVRQA PGKGLEWVSY IRPSGGQTYY    60
ADSVKGRFTI SRDNSKNTLY LQMNSLRAED TAVYYCAYRR TGIPRRDAFD IWGQGTMVTV   120
SSASTKGPSV FPLAPSSKS                                                139

M195-C12 LC (SEQ ID NO: 1107)
QDIQMTQSPS TLSASVGDRV TITCRASQSI SSWLAWYQQK PGKAPNLLIY KASTLESGVP    60
SRFSGSGSGT EFTLTISSLQ PDDFATYYCQ QYNTYWTFGQ GTKVEIK                 107

M195-C12 HC (SEQ ID NO: 1108)
EVQLLESGGG LVQPGGSLRL SCAASGFTFS MYQMFWVRQA PGKGLEWVSS ISPGGGTQYA    60
DSVKGRFTIS RDNSKNTLYL QMNSLRAEDT AVYYCAYRRT GIPRRDAFDI WGQGTMVTVS   120
SASTKGPSVF PLAPSSKS                                                 138

M195-D12 LC (SEQ ID NO: 1109)
QDIQMTQSPS TLSASVGDRV TITCRASQSI SSWLAWYQQK PGKAPNLLIY KASTLESGVP    60
SRFSGSGSGT EFTLTISSLQ PDDFATYYCQ QYNTYWTFGQ GTKVEIK                 107

M195-D12 HC (SEQ ID NO: 1110)
EVQLLESGGG LVQPGGSLRL SCAASGFTFS IYGMFWVRQA PGKGLEWVSG IGPSGGPTKY    60
ADSVKGRFTI SRDNSKNTLY LQMNSLRAED TAVYYCAYRR TGIPRRDAFD IWGQGTMVTV   120
SSASTKGPSV FPLAPSSKS                                                139

M195-E12 LC (SEQ ID NO: 1111)
QDIQMTQSPS TLSASVGDRV TITCRASQSI SSWLAWYQQK PGKAPNLLIY KASTLESGVP    60
SRFSGSGSGT EFTLTISSLQ PDDFATYYCQ QYNTYWTFGQ GTKVEIK                 107

M195-E12 HC (SEQ ID NO: 1112)
EVQLLESGGG LVQPGGSLRL SCAASGFTFS YYIMFWVRQA PGKGLEWVSY ISPGGYTHY     60
ADSVKGRFTI SRDNSKNTLY LQMNSLRAED TAVYYCAYRR TGIPRRDAFD IWGQGTMVTV   120
SSASTKGPSV FPLAPSSKS                                                139

M195-F12 LC (SEQ ID NO: 1113)
QDIQMTQSPS TLSASVGDRV TITCRASQSI SSWLAWYQQK PGKAPNLLIY KASTLESGVP    60
SRFSGSGSGT EFTLTISSLQ PDDFATYYCQ QYNTYWTFGQ GTKVEIK                 107

M195-F12 HC (SEQ ID NO: 1114)
EVQLLESGGG LVQPGGSLRL SCAASGFTFS HYVMMWVRQA PGKGLEWVSY IVPSGGVTAY    60
ADSVKGRFTI SRDNSKNTLY LQMNSLRAED TAVYYCAYRR TGIPRRDAFD IWGQGTMVTV   120
SSASTKGPSV FPLAPSSKS                                                139

M0195-G02 LC (SEQ ID NO: 1115)
QDIQMTQSPS TLSASVGDRV TITCRASQSI SSWLAWYQQK PGKAPNLLIY KASTLESGVP    60
SRFSGSGSGT EFTLTISSLQ PDDFATYYCQ QYNTYWTFGQ GTKVEIK                 107

M195-G02 HC (SEQ ID NO: 1116)
EVQLLESGGG LVQPGGSLRL SCAASGFTFS PYNMMWVRQA PGKGLEWVSS IWPSGGTTDY    60
ADSVKGRFTI SRDNSKNTLY LQMNSLRAED TAVYYCAYRR TGIPRRDAFD IWGQGTMVTV   120
SSASTKGPSV FPLAPSSKS                                                139

M196-C06 LC (SEQ ID NO: 1117)
QDIQMTQSPS TLSASVGDRV TITCRASQSI SSWLAWYQQK PGKAPNLLIY KASTLESGVP    60
SRFSGSGSGT EFTLTISSLQ PDDFATYYCQ QYNTYWTFGQ GTKVEIK                 107

M196-C06 HC (SEQ ID NO: 1118)
EVQLLESGGG LVQPGGSLRL SCAASGFTFS IYSMHWVRQA PGKGLEWVSS IYPSRGMTWY    60
ADSVKGRFTI SRDNSKNTLY LQMNSLRAED TAVYYCAYRR TGIPRRDAFD IWGQGTMVTV   120
SSASTKGPSV FPLAPSSKS                                                139

M196-D02 LC (SEQ ID NO: 1119)
QDIQMTQSPS TLSASVGDRV TITCRASQSI SSWLAWYQQK PGKAPNLLIY KASTLESGVP    60
SRFSGSGSGT EFTLTISSLQ PDDFATYYCQ QYNTYWTFGQ GTKVEIK                 107

M196-D02 HC (SEQ ID NO: 1120)
EVQLLESGGG LVQPGGSLRL SCAASGFTFS VYSMHWVRQA PGKGLEWVSV IGPSGGITLY    60
ADSVKGRFTI SRDNSKNTLY LQMNSLRAED TAVYYCAYRR TGIPRRDAFD IWGQGTMVTV   120
SSASTKGPSV FPLAPSSKS                                                139

M196-D12 LC (SEQ ID NO: 1121)
QDIQMTQSPS TLSASVGDRV TITCRASQSI SSWLAWYQQK PGKAPNLLIY KASTLESGVP    60
SRFSGSGSGT EFTLTISSLQ PDDFATYYCQ QYNTYWTFGQ GTKVEIK                 107

M196-D12 HC (SEQ ID NO: 1122)
EVQLLESGGG LVQPGGSLRL SCAASGFTFS RYSMRWVRQA PGKGLEWVSV IYPSGGQTYY    60
ADSVKGRFTI SRDNSKNTLY LQMNSLRAED TAVYYCAYRR TGIPRRDAFD IWGQGTMVTV   120
SSASTKGPSV FPLAPSSKS                                                139

M196-G12 LC (SEQ ID NO: 1123)
QDIQMTQSPS TLSASVGDRV TITCRASQSI SSWLAWYQQK PGKAPNLLIY KASTLESGVP    60
SRFSGSGSGT EFTLTISSLQ PDDFATYYCQ QYNTYWTFGQ GTKVEIK                 107
```

-continued

```
M196-G12 HC (SEQ ID NO: 1124)
EVQLLESGGG LVQPGGSLRL SCAASGFTFS NYSMDWVRQA PGKGLEWVSR IYSSGGGTIY    60
ADSVKGRFTI SRDNSKNTLY LQMNSLRAED TAVYYCAYRR TGIPRRDAFD IWGQGTMVTV   120
SSASTKGPSV FPLAPSSKS                                                139

M196-H03 LC (SEQ ID NO: 1125)
QDIQMTQSPS TLSASVGDRV TITCRASQSI SSWLAWYQQK PGKAPNLLIY KASTLESGVP    60
SRFSGSGSGT EFTLTISSLQ PDDFATYYCQ QYNTYWTFGQ GTKVEIK                 107

M196-H03 HC (SEQ ID NO: 1126)
EVQLLESGGG LVQPGGSLRL SCAASGFTFS RYVMWWVRQA PGKGLEWVSS ISPSGDTHYA    60
DSVKGRFTIS RDNSKNTLYL QMNSLRAEDT AVYYCAYRRT GIPRRDAFDI WGQGTMVTVS   120
SASTKGPSVF PLAPSSKS                                                 138

M197-A01 LC (SEQ ID NO: 1127)
QDIQMTQSPS TLSASVGDRV TITCRASQSI SSWLAWYQQK PGKAPNLLIY KASTLESGVP    60
SRFSGSGSGT EFTLTISSLQ PDDFATYYCQ QYNTYWTFGQ GTKVEIK                 107

M197-A01 HC (SEQ ID NO: 1128)
EVQLLESGGG LVQPGGSLRL SCAASGFTFS IYDMIWVRQA PGKGLEWVSS IYPSGGNTSY    60
ADSVKGRFTI SRDNSKNTLY LQMNSLRAED TAVYYCAYRR TGIPRRDAFD IWGQGTMVTV   120
SSASTKGPSV FPLAPSSKS                                                139

M197-A08 LC (SEQ ID NO: 1129)
QDIQMTQSPS TLSASVGDRV TITCRASQSI SSWLAWYQQK PGKAPNLLIY KASTLESGVP    60
SRFSGSGSGT EFTLTISSLQ PDDFATYYCQ QYNTYWTFGQ GTKVEIK                 107

M197-A08 HC (SEQ ID NO: 1130)
EVQLLESGGG LVQPGGSLRL SCAASGFTFS IYSMQWVRQA PGKGLEWVSS IGSSGGKTLY    60
ADSVKGRFTI SRDNSKNTLY LQMNSLRAED TAVYYCAYRR TGIPRRDAFD IWGQGTMVTV   120
SSASTKGPSV FPLAPSSKS                                                139

M197-A09 LC (SEQ ID NO: 1131)
QDIQMTQSPS TLSASVGDRV TITCRASQSI SSWLAWYQQK PGKAPNLLIY KASTLESGVP    60
SRFSGSGSGT EFTLTISSLQ PDDFATYYCQ QYNTYWTFGQ GTKVEIK                 107

M197-A09 HC (SEQ ID NO: 1132)
EVQLLESGGG LVQPGGSLRL SCAASGFTFS VYNMHWVRQA PGKGLEWVSS IYPSGGMTTY    60
ADSVKGRFTI SRDNSKNTLY LQMNSLRAED TAVYYCAYRR TGIPRRDAFD IWGQGTMVTV   120
SSASTKGPSV FPLAPSSKS                                                139

M197-C12 LC (SEQ ID NO: 1133)
QDIQMTQSPS TLSASVGDRV TITCRASQSI SSWLAWYQQK PGKAPNLLIY KASTLESGVP    60
SRFSGSGSGT EFTLTISSLQ PDDFATYYCQ QYNTYWTFGQ GTKVEIK                 107

M197-C12 HC (SEQ ID NO: 1134)
EVQLLESGGG LVQPGGSLRL SCAASGFTFS PYDMLWVRQA PGKGLEWVSY IVSSGGLTKY    60
ADSVKGRFTI SRDNSKNTLY LQMNSLRAED TAVYYCAYRR TGIPRRDAFD IWGQGTMVTV   120
SSASTKGPSV FPLAPSSKS                                                139

M197-E12 LC (SEQ ID NO: 1135)
QDIQMTQSPS TLSASVGDRV TITCRASQSI SSWLAWYQQK PGKAPNLLIY KASTLESGVP    60
SRFSGSGSGT EFTLTISSLQ PDDFATYYCQ QYNTYWTFGQ GTKVEIK                 107

M197-E12 HC (SEQ ID NO: 1136)
EVQLLESGGG LVQPGGSLRL SCAASGFTFS TYTMRWVRQA PGKGLEWVSS IYPSGGKTQY    60
ADSVKGRFTI SRDNSKNTLY LQMNSLRAED TAVYYCAYRR TGIPRRDAFD IWGQGTMVTV   120
SSASTKGPSV FPLAPSSKS                                                139

M197-F01 LC (SEQ ID NO: 1137)
QDIQMTQSPS TLSASVGDRV TITCRASQSI SSWLAWYQQK PGKAPNLLIY KASTLESGVP    60
SRFSGSGSGT EFTLTISSLQ PDDFATYYCQ QYNTYWTFGQ GTKVEIK                 107

M197-F01 HC (SEQ ID NO: 1138)
EVQLLESGGG LVQPGGSLRL SCAASGFTFS IYHMYWVRQA PGKGLEWVSS IGPSGGPTGY    60
ADSVKGRFTI SRDNSKNTLY LQMNSLRAED TAVYYCAYRR TGIPRRDAFD IWGQGTMVTV   120
SSASTKGPSV FPLAPSSKS                                                139

M197-F03 LC (SEQ ID NO: 1139)
QDIQMTQSPS TLSASVGDRV TITCRASQSI SSWLAWYQQK PGKAPNLLIY KASTLESGVP    60
SRFSGSGSGT EFTLTISSLQ PDDFATYYCQ QYNTYWTFGQ GTKVEIK                 107

M197-F03 HC (SEQ ID NO: 1140)
EVQLLESGGG LVQPGGSLRL SCAASGFTFS IYSMFWVRQA PGKGLEWVSS IGPSGGVTHY    60
ADSVKGRFTI SRDNSKNTLY LQMNSLRAED TAVYYCAYRR TGIPRRDAFD IWGQGTMVTV   120
SSASTKGPSV FPLAPSSKS                                                139

M197-G10 LC (SEQ ID NO: 1141)
QDIQMTQSPS TLSASVGDRV TITCRASQSI SSWLAWYQQK PGKAPNLLIY KASTLESGVP    60
SRFSGSGSGT EFTLTISSLQ PDDFATYYCQ QYNTYWTFGQ GTKVEIK                 107
```

```
M197-G10 HC (SEQ ID NO: 1142)
EVQLLESGGG LVQPGGSLRL SCAASGFTFS VYAMRWVRQA PGKGLEWVSS IYPSGGKTWY    60
ADSVKGRFTI SRDNSKNTLY LQMNSLRAED TAVYYCAYRR TGIPRRDAFD IWGQGTMVTV   120
SSASTKGPSV FPLAPSSKS                                                139

M197-G11 LC (SEQ ID NO: 1143)
QDIQMTQSPS TLSASVGDRV TITCRASQSI SSWLAWYQQK PGKAPNLLIY KASTLESGVP    60
SRFSGSGSGT EFTLTISSLQ PDDFATYYCQ QYNTYWTFGQ GTKVEIK                 107

M197-G11 HC (SEQ ID NO: 1144)
EVQLLESGGG LVQPGGSLRL SCAASGFTFS TYAMVWVRQA PGKGLEWVSS IYPSGGITTY    60
ADSVKGRFTI SRDNSKNTLY LQMNSLRAED TAVYYCAYRR TGIPRRDAFD IWGQGTMVTV   120
SSASTKGPSV FPLAPSSKS                                                139

M197-H10 LC (SEQ ID NO: 1145)
QDIQMTQSPS TLSASVGDRV TITCRASQSI SSWLAWYQQK PGKAPNLLIY KASTLESGVP    60
SRFSGSGSGT EFTLTISSLQ PDDFATYYCQ QYNTYWTFGQ GTKVEIK                 107

M197-H10 HC (SEQ ID NO: 1146)
EVQLLESGGG LVQPGGSLRL SCAASGFTFS SYNMHWVRQA PGKGLEWVSS IVPSGGKTNY    60
ADSVKGRFTI SRDNSKNTLY LQMNSLRAED TAVYYCAYRR TGIPRRDAFD IWGQGTMVTV   120
SSASTKGPSV FPLAPSSKS                                                139

M197-H11 LC (SEQ ID NO: 1147)
QDIQMTQSPS TLSASVGDRV TITCRASQSI SSWLAWYQQK PGKAPNLLIY KASTLESGVP    60
SRFSGSGSGT EFTLTISSLQ PDDFATYYCQ QYNTYWTFGQ GTKVEIK                 107

M197-H11 HC (SEQ ID NO: 1148)
EVQLLESGGG LVQPGGSLRL SCAASGFTFS IYNMIWVRQA PGKGLEWVSS IYPSGGWTTY    60
ADSVKGRFTI SRDNSKNTLY LQMNSLRAED TAVYYCAYRR TGIPRRDAFD IWGQGTMVTV   120
SSASTKGPSV FPLAPSSKS                                                139

M198-A01 LC (SEQ ID NO: 1149)
QDIQMTQSPS TLSASVGDRV TITCRASQSI SSWLAWYQQK PGKAPNLLIY KASTLESGVP    60
SRFSGSGSGT EFTLTISSLQ PDDFATYYCQ QYNTYWTFGQ GTKVEIK                 107

M198-A01 HC (SEQ ID NO: 1150)
EVQLLESGGG LVQPGGSLRL SCAASGFTFS PYTMIWVRQA PGKGLEWVSS ISSSGGMTPY    60
ADSVKGRFTI SRDNSKNTLY LQMNSLRAED TAVYYCAYRR TGIPRRDAFD IWGQGTMVTV   120
SSASTKGPSV FPLAPSSKS                                                139

M198-A02 LC (SEQ ID NO: 1151)
QDIQMTQSPS TLSASVGDRV TITCRASQSI SSWLAWYQQK PGKAPNLLIY KASTLESGVP    60
SRFSGSGSGT EFTLTISSLQ PDDFATYYCQ QYNTYWTFGQ GTKVEIK                 107

M198-A02 HC (SEQ ID NO: 1152)
EVQLLESGGG LVQPGGSLRL SCAASGFTFS RYSMIWVRQA PGKGLEWVSS IWSSGGATEY    60
ADSVKGRFTI SRDNSKNTLY LQMNSLRAED TAVYYCAYRR TGIPRRDAFD IWGQGTMVTV   120
SSASTKGPSV FPLAPSSKS                                                139

M198-A06 LC (SEQ ID NO: 1153)
QDIQMTQSPS TLSASVGDRV TITCRASQSI SSWLAWYQQK PGKAPNLLIY KASTLESGVP    60
SRFSGSGSGT EFTLTISSLQ PDDFATYYCQ QYNTYWTFGQ GTKVEIK                 107

M198-A06 HC (SEQ ID NO: 1154)
EVQLLESGGG LVQPGGSLRL SCAASGFTFS IYSMHWVRQA PGKGLEWVSS IYSSGGPTKY    60
ADSVKGRFTI SRDNSKNTLY LQMNSLRAED TAVYYCAYRR TGIPRRDAFD IWGQGTMVTV   120
SSASTKGPSV FPLAPSSKS                                                139

M198-A07 LC (SEQ ID NO: 1155)
QDIQMTQSPS TLSASVGDRV TITCRASQSI SSWLAWYQQK PGKAPNLLIY KASTLESGVP    60
SRFSGSGSGT EFTLTISSLQ PDDFATYYCQ QYNTYWTFGQ GTKVEIK                 107

M198-A07 HC (SEQ ID NO: 1156)
EVQLLESGGG LVQPGGSLRL SCAASGFTFS RYQMHWVRQA PGKGLEWVSW ISPSGGITGY    60
ADSVKGRFTI SRDNSKNTLY LQMNSLRAED TAVYYCAYRR TGIPRRDAFD IWGQGTMVTV   120
SSASTKGPSV FPLAPSSKS                                                139

M198-A08 LC (SEQ ID NO: 1157)
QDIQMTQSPS TLSASVGDRV TITCRASQSI SSWLAWYQQK PGKAPNLLIY KASTLESGVP    60
SRFSGSGSGT EFTLTISSLQ PDDFATYYCQ QYNTYWTFGQ GTKVEIK                 107

M198-A08 HC (SEQ ID NO: 1158)
EVQLLESGGG LVQPGGSLRL SCAASGFTFS WYMMQWVRQA PGKGLEWVSR ISPSGGTTYA    60
DSVKGRFTIS RDNSKNTLYL QMNSLRAEDT AVYYCAYRRT GIPRRDAFDI WGQGTMVTVS   120
SASTKGPSVF PLAPSSKS                                                 138

M198-A09 LC (SEQ ID NO: 1159)
QDIQMTQSPS TLSASVGDRV TITCRASQSI SSWLAWYQQK PGKAPNLLIY KASTLESGVP    60
SRFSGSGSGT EFTLTISSLQ PDDFATYYCQ QYNTYWTFGQ GTKVEIK                 107
```

```
M198-A09 HC (SEQ ID NO: 1160)
EVQLLESGGG LVQPGGSLRL SCAASGFTFS IYFMSWVRQA PGKGLEWVSS IRSSGGPTWY    60
ADSVKGRFTI SRDNSKNTLY LQMNSLRAED TAVYYCAYRR TGIPRRDAFD IWGQGTMVTV   120
SSASTKGPSV FPLAPSSKS                                                139

M198-B09 LC (SEQ ID NO: 1161)
QDIQMTQSPS TLSASVGDRV TITCRASQSI SSWLAWYQQK PGKAPNLLIY KASTLESGVP    60
SRFSGSGSGT EFTLTISSLQ PDDFATYYCQ QYNTYWTFGQ GTKVEIK                 107

M198-B09 HC (SEQ ID NO: 1162)
EVQLLESGGG LVQPGGSLRL SCAASGFTFS VYSMTWVRQA PGKGLEWVSS IGSSGGSTTY    60
ADSVKGRFTI SRDNSKNTLY LQMNSLRAED TAVYYCAYRR TGIPRRDAFD IWGQGTMVTV   120
SSASTKGPSV FPLAPSSKS                                                139

M198-B12 LC (SEQ ID NO: 1163)
QDIQMTQSPS TLSASVGDRV TITCRASQSI SSWLAWYQQK PGKAPNLLIY KASTLESGVP    60
SRFSGSGSGT EFTLTISSLQ PDDFATYYCQ QYNTYWTFGQ GTKVEIK                 107

M198-B12 HC (SEQ ID NO: 1164)
EVQLLESGGG LVQPGGSLRL SCAASGFTFS KYSMAWVRQA PGKGLEWVSG IYPSGGRTLY    60
ADSVKGRFTI SRDNSKNTLY LQMNSLRAED TAVYYCAYRR TGIPRRDAFD IWGQGTMVTV   120
SSASTKGPSV FPLAPSSKS                                                139

M198-C03 LC (SEQ ID NO: 1165)
QDIQMTQSPS TLSASVGDRV TITCRASQSI SSWLAWYQQK PGKAPNLLIY KASTLESGVP    60
SRFSGSGSGT EFTLTISSLQ PDDFATYYCQ QYNTYWTFGQ GTKVEIK                 107

M198-C03 HC (SEQ ID NO: 1166)
EVQLLESGGG LVQPGGSLRL SCAASGFTFS RYSMSWVRQA PGKGLEWVSG ISPSGGETSY    60
ADSVKGRFTI SRDNSKNTLY LQMNSLRAED TAVYYCAYRR TGIPRRDAFD IWGQGTMVTV   120
SSASTKGPSV FPLAPSSKS                                                139

M198-C05 LC (SEQ ID NO: 1167)
QDIQMTQSPS TLSASVGDRV TITCRASQSI SSWLAWYQQK PGKAPNLLIY KASTLESGVP    60
SRFSGSGSGT EFTLTISSLQ PDDFATYYCQ QYNTYWTFGQ GTKVEIK                 107

M198-C05 HC (SEQ ID NO: 1168)
EVQLLESGGG LVQPGGSLRL SCAASGFTFS RYKMYWVRQA PGKGLEWVSV IGPSGGATFY    60
ADSVKGRFTI SRDNSKNTLY LQMNSLRAED TAVYYCAYRR TGIPRRDAFD IWGQGTMVTV   120
SSASTKGPSV FPLAPSSKS                                                139

M198-C06 LC (SEQ ID NO: 1169)
QDIQMTQSPS TLSASVGDRV TITCRASQSI SSWLAWYQQK PGKAPNLLIY KASTLESGVP    60
SRFSGSGSGT EFTLTISSLQ PDDFATYYCQ QYNTYWTFGQ GTKVEIK                 107

M198-C06 HC (SEQ ID NO: 1170)
EVQLLESGGG LVQPGGSLRL SCAASGFTFS QYFMHWVRQA PGKGLEWVSY IYPSGGMTEY    60
ADSVKGRFTI SRDNSKNTLY LQMNSLRAED TAVYYCAYRR TGIPRRDAFD IWGQGTMVTV   120
SSASTKGPSV FPLAPSSKS                                                139

M198-C09 LC (SEQ ID NO: 1171)
QDIQMTQSPS TLSASVGDRV TITCRASQSI SSWLAWYQQK PGKAPNLLIY KASTLESGVP    60
SRFSGSGSGT EFTLTISSLQ PDDFATYYCQ QYNTYWTFGQ GTKVEIK                 107

M198-C09 HC (SEQ ID NO: 1172)
EVQLLESGGG LVQPGGSLRL SCAASGFTFS IYTMYWVRQA PGKGLEWVSS ISPSGGWTYY    60
ADSVKGRFTI SRDNSKNTLY LQMNSLRAED TAVYYCAYRR TGIPRRDAFD IWGQGTMVTV   120
SSASTKGPSV FPLAPSSKS                                                139

M198-C10 LC (SEQ ID NO: 1173)
QDIQMTQSPS TLSASVGDRV TITCRASQSI SSWLAWYQQK PGKAPNLLIY KASTLESGVP    60
SRFSGSGSGT EFTLTISSLQ PDDFATYYCQ QYNTYWTFGQ GTKVEIK                 107

M198-C10 HC (SEQ ID NO: 1174)
EVQLLESGGG LVQPGGSLRL SCAASGFTFS HYMGMNWVRQ APGKGLEWVS SIVPSGGWTQ    60
YADSVKGRFT ISRDNSKNTL YLQMNSLRAE DTAVYYCAYR RTGIPRRDAF DIWGQGTMVT   120
VSSASTKGPS VFPLAPSSKS                                               140

M198-D12 LC (SEQ ID NO: 1175)
QDIQMTQSPS TLSASVGDRV TITCRASQSI SSWLAWYQQK PGKAPNLLIY KASTLESGVP    60
SRFSGSGSGT EFTLTISSLQ PDDFATYYCQ QYNTYWTFGQ GTKVEIK                 107

M198-D12 HC (SEQ ID NO: 1176)
EVQLLESGGG LVQPGGSLRL SCAASGFTFS LYVMYWVRQA PGKGLEWVSY IVPSGGPTAY    60
ADSVKGRFTI SRDNSKNTLY LQMNSLRAED TAVYYCAYRR TGIPRRDAFD IWGQGTMVTV   120
SSASTKGPSV FPLAPSSKS                                                139

M198-E02 LC (SEQ ID NO: 1177)
QDIQMTQSPS TLSASVGDRV TITCRASQSI SSWLAWYQQK PGKAPNLLIY KASTLESGVP    60
SRFSGSGSGT EFTLTISSLQ PDDFATYYCQ QYNTYWTFGQ GTKVEIK                 107
```

```
M198-E02 HC (SEQ ID NO: 1178)
EVQLLESGGG LVQPGGSLRL SCAASGFTFS IYSMYWVRQA PGKGLEWVSY IRPSGGNTKY    60
ADSVKGRFTI SRDNSKNTLY LQMNSLRAED TAVYYCAYRR TGIPRRDAFD IWGQGTMVTV   120
SSASTKGPSV FPLAPSSKS                                                139

M198-E09 LC (SEQ ID NO: 1179)
QDIQMTQSPS TLSASVGDRV TITCRASQSI SSWLAWYQQK PGKAPNLLIY KASTLESGVP    60
SRFSGSGSGT EFTLTISSLQ PDDFATYYCQ QYNTYWTFGQ GTKVEIK                 107

M198-E09 HC (SEQ ID NO: 1180)
EVQLLESGGG LVQPGGSLRL SCAASGFTFS IYDMNWVRQA PGKGLEWVSS IYPSGGRTRY    60
ADSVKGRFTI SRDNSKNTLY LQMNSLRAED TAVYYCAYRR TGIPRRDAFD IWGQGTMVTV   120
SSASTKGPSV FPLAPSSKS                                                139

M198-E11 LC (SEQ ID NO: 1181)
QDIQMTQSPS TLSASVGDRV TITCRASQSI SSWLAWYQQK PGKAPNLLIY KASTLESGVP    60
SRFSGSGSGT EFTLTISSLQ PDDFATYYCQ QYNTYWTFGQ GTKVEIK                 107

M198-E11 HC (SEQ ID NO: 1182)
EVQLLESGGG LVQPGGSLRL SCAASGFTFS TYSMYWVRQA PGKGLEWVSS IYPSGGLTWY    60
ADSVKGRFTI SRDNSKNTLY LQMNSLRAED TAVYYCAYRR TGIPRRDAFD IWGQGTMVTV   120
SSASTKGPSV FPLAPSSKS                                                139

M198-F04 LC (SEQ ID NO: 1183)
QDIQMTQSPS TLSASVGDRV TITCRASQSI SSWLAWYQQK PGKAPNLLIY KASTLESGVP    60
SRFSGSGSGT EFTLTISSLQ PDDFATYYCQ QYNTYWTFGQ GTKVEIK                 107

M198-F04 HC (SEQ ID NO: 1184)
EVQLLESGGG LVQPGGSLRL SCAASGFTFS IYDMWWVRQA PGKGLEWVSS IRPSGGITKY    60
ADSVKGRFTI SRDNSKNTLY LQMNSLRAED TAVYYCAYRR TGIPRRDAFD IWGQGTMVTV   120
SSASTKGPSV FPLAPSSKS                                                139

M198-F08 LC (SEQ ID NO: 1185)
QDIQMTQSPS TLSASVGDRV TITCRASQSI SSWLAWYQQK PGKAPNLLIY KASTLESGVP    60
SRFSGSGSGT EFTLTISSLQ PDDFATYYCQ QYNTYWTFGQ GTKVEIK                 107

M198-F08 HC (SEQ ID NO: 1186)
EVQLLESGGG LVQPGGSLRL SCAASGFTFS VYSMWWVRQA PGKGLEWVSS ISSSGGMTEY    60
ADSVKGRFTI SRDNSKNTLY LQMNSLRAED TAVYYCAYRR TGIPRRDAFD IWGQGTMVTV   120
SSASTKGPSV FPLAPSSKS                                                139

M198-F09 LC (SEQ ID NO: 1187)
QDIQMTQSPS TLSASVGDRV TITCRASQSI SSWLAWYQQK PGKAPNLLIY KASTLESGVP    60
SRFSGSGSGT EFTLTISSLQ PDDFATYYCQ QYNTYWTFGQ GTKVEIK                 107

M198-F09 HC (SEQ ID NO: 1188)
EVQLLESGGG LVQPGGSLRL SCAASGFTFS VYNMHWVRQA PGKGLEWVSS IYPSGGMTYY    60
ADSVKGRFTI SRDNSKNTLY LQMNSLRAED TAVYYCAYRR TGIPRRDAFD IWGQGTMVTV   120
SSASTKGPSV FPLAPSSKS                                                139

M198-F12 LC (SEQ ID NO: 1189)
QDIQMTQSPS TLSASVGDRV TITCRASQSI SSWLAWYQQK PGKAPNLLIY KASTLESGVP    60
SRFSGSGSGT EFTLTISSLQ PDDFATYYCQ QYNTYWTFGQ GTKVEIK                 107

M198-F12 HC (SEQ ID NO: 1190)
EVQLLESGGG LVQPGGSLRL SCAASGFTFS IYTMMWVRQA PGKGLEWVSS IWSSGGQTKY    60
ADSVKGRFTI SRDNSKNTLY LQMNSLRAED TAVYYCAYRR TGIPRRDAFD IWGQGTMVTV   120
SSASTKGPSV FPLAPSSKS                                                139

M198-G03 LC (SEQ ID NO: 1191)
QDIQMTQSPS TLSASVGDRV TITCRASQSI SSWLAWYQQK PGKAPNLLIY KASTLESGVP    60
SRFSGSGSGT EFTLTISSLQ PDDFATYYCQ QYNTYWTFGQ GTKVEIK                 107

M198-G03 HC (SEQ ID NO: 1192)
EVQLLESGGG LVQPGGSLRL SCAASGFTFS QYTMVWVRQA PGKGLEWVSW IYSSRANYAD    60
SVKGRFTISR DNSKNTLYLQ MNSLRAEDTA VYYCAYRRTG IPRRDAFDIW GQGTMVTVSS   120
ASTKGPSVFP LAPSSKS                                                  137

M198-G07 LC (SEQ ID NO: 1193)
QDIQMTQSPS TLSASVGDRV TITCRASQSI SSWLAWYQQK PGKAPNLLIY KASTLESGVP    60
SRFSGSGSGT EFTLTISSLQ PDDFATYYCQ QYNTYWTFGQ GTKVEIK                 107

M198-G07 HC (SEQ ID NO: 1194)
EVQLLESGGG LVQPGGSLRL SCAASGFTFS IYDMTWVRQA PGKGLEWVSS IYPSGGQTIY    60
ADSVKGRFTI SRDNSKNTLY LQMNSLRAED TAVYYCAYRR TGIPRRDAFD IWGQGTMVTV   120
SSASTKGPSV FPLAPSSKS                                                139

M198-H02 LC (SEQ ID NO: 1195)
QDIQMTQSPS TLSASVGDRV TITCRASQSI SSWLAWYQQK PGKAPNLLIY KASTLESGVP    60
SRFSGSGSGT EFTLTISSLQ PDDFATYYCQ QYNTYWTFGQ GTKVEIK                 107
```

```
M198-H02 HC (SEQ ID NO: 1196)
EVQLLESGGG LVQPGGSLRL SCAASGFTFS PYNMWVRQA PGKGLEWVSW IVPGGVTKYA    60
DSVKGRFTIS RDNSKNTLYL QMNSLRAEDT AVYYCAYRRT GIPRRDAFDI WGQGTMVTVS   120
SASTKGPSVF PLAPSSKS                                                138

M198-H08 LC (SEQ ID NO: 1197)
QDIQMTQSPS TLSASVGDRV TITCRASQSI SSWLAWYQQK PGKAPNLLIY KASTLESGVP    60
SRFSGSGSGT EFTLTISSLQ PDDFATYYCQ QYNTYWTFGQ GTKVEIK                 107

M198-H08 HC (SEQ ID NO: 1198)
EVQLLESGGG LVQPGGSLRL SCAASGFTFS IYDMWVRQA PGKGLEWVSS IGPSGGPTAY     60
ADSVKGRFTI SRDNSKNTLY LQMNSLRAED TAVYYCAYRR TGIPRRDAFD IWGQGTMVTV   120
SSASTKGPSV FPLAPSSKS                                               139

M198-H09 LC (SEQ ID NO: 1199)
QDIQMTQSPS TLSASVGDRV TITCRASQSI SSWLAWYQQK PGKAPNLLIY KASTLESGVP    60
SRFSGSGSGT EFTLTISSLQ PDDFATYYCQ QYNTYWTFGQ GTKVEIK                 107

M198-H09 HC (SEQ ID NO: 1200)
EVQLLESGGG LVQPGGSLRL SCAASGFTFS IYLMIWVRQA PGKGLEWVSY IGPSGGPTEY    60
ADSVKGRFTI SRDNSKNTLY LQMNSLRAED TAVYYCAYRR TGIPRRDAFD IWGQGTMVTV   120
SSASTKGPSV FPLAPSSKS                                               139

M199-A08 LC (SEQ ID NO: 1201)
QDIQMTQSPS TLSASVGDRV TITCRASQSI SSWLAWYQQK PGKAPNLLIY KASTLESGVP    60
SRFSGSGSGT EFTLTISSLQ PDDFATYYCQ QYNTYWTFGQ GTKVEIK                 107

M199-A08 HC (SEQ ID NO: 1202)
EVQLLESGGG LVQPGGSLRL SCAASGFTFS HYIMMWVRQA PGKGLEWVSG IYSSGGITVY    60
ADSVKGRFTI SRDNSKNTLY LQMNSLRAED TAVYYCAYRR IGVPRRDEFD IWGQGTMVTV   120
SSASTKGPSV FPLAPSSKS                                               139

M199-A11 LC (SEQ ID NO: 1203)
QDIQMTQSPS TLSASVGDRV TITCRASQSI SSWLAWYQQK PGKAPNLLIY KASTLESGVP    60
SRFSGSGSGT EFTLTISSLQ PDDFATYYCQ QYNTYWTFGQ GTKVEIK                 107

M199-A11 HC (SEQ ID NO: 1204)
EVQLLESGGG LVQPGGSLRL SCAASGFTFS HYIMMWVRQA PGKGLEWVSG IYSSGGITVY    60
ADSVKGRFTI SRDNSKNTLY LQMNSLRAED TAVYYCAYRR RGIPRRDAFD IWGQGTMVTV   120
SSASTKGPSV FPLAPSSKS                                               139

M199-B01 LC (SEQ ID NO: 1205)
QDIQMTQSPS TLSASVGDRV TITCRASQSI SSWLAWYQQK PGKAPNLLIY KASTLESGVP    60
SRFSGSGSGT EFTLTISSLQ PDDFATYYCQ QYNTYWTFGQ GTKVEIK                 107

M199-B01 HC (SEQ ID NO: 1206)
EVQLLESGGG LVQPGGSLRL SCAASGFTFS HYIMMWVRQA PGKGLEWVSG IYSSGGITVY    60
ADSVKGRFTI SRDNSKNTLY LQMNSLRAED TAVYYCAFRR TGIPRRDAFD NWGQGTMVTV   120
SSASTKGPSV FPLAPSSKS                                               139

M200-A10 LC (SEQ ID NO: 1207)
QDIQMTQSPS TLSASVGDRV TITCRASQSI SSWLAWYQQK PGKAPNLLIY KASTLESGVP    60
SRFSGSGSGT EFTLTISSLQ PDDFATYYCQ QYNTYWTFGQ GTKVEIK                 107

M200-A10 HC (SEQ ID NO: 1208)
EVQLLESGGG LVQPGGSLRL SCAASGFTFS HYIMMWVRQA PGKGLEWVSG IYSSGGITVY    60
ADSVKGRFTI SRDNSKNTLY LQMNSLRAED TAVYYCAYRR TGVPRRDSFD IWGQGTMVTV   120
SSASTKGPSV FPLAPSSKS                                               139

M200-B01 LC (SEQ ID NO: 1209)
QDIQMTQSPS TLSASVGDRV TITCRASQSI SSWLAWYQQK PGKAPNLLIY KASTLESGVP    60
SRFSGSGSGT EFTLTISSLQ PDDFATYYCQ QYNTYWTFGQ GTKVEIK                 107

M200-B01 HC (SEQ ID NO: 1210)
EVQLLESGGG LVQPGGSLRL SCAASGFTFS HYIMMWVRQA PGKGLEWVSG IYSSGGITVY    60
ADSVKGRFTI SRDNSKNTLY LQMNSLRAED TAVYYCAYRR TGIPRRDAFD SWGQGTMVTV   120
SSASTKGPSV FPLAPSSKS                                               139

M200-D03 LC (SEQ ID NO: 1211)
QDIQMTQSPS TLSASVGDRV TITCRASQSI SSWLAWYQQK PGKAPNLLIY KASTLESGVP    60
SRFSGSGSGT EFTLTISSLQ PDDFATYYCQ QYNTYWTFGQ GTKVEIK                 107

M200-D03 HC (SEQ ID NO: 1212)
EVQLLESGGG LVQPGGSLRL SCAASGFTFS HYIMMWVRQA PGKGLEWVSG IYSSGGITVY    60
ADSVKGRFTI SRDNSKNTLY LQMNSLRAED TAVYYCAWRR IGVPRRDSFD MWGQGTMVTV   120
SSASTKGPSV FPLAPSSKS                                               139

M200-E11 LC (SEQ ID NO: 1213)
QDIQMTQSPS TLSASVGDRV TITCRASQSI SSWLAWYQQK PGKAPNLLIY KASTLESGVP    60
SRFSGSGSGT EFTLTISSLQ PDDFATYYCQ QYNTYWTFGQ GTKVEIK                 107
```

-continued

```
M200-E11 HC (SEQ ID NO: 1214)
EVQLLESGGG LVQPGGSLRL SCAASGFTFS HYIMMWVRQA PGKGLEWVSG IYSSGGITVY    60
ADSVKGRFTI SRDNSKNTLY LQMNSLRAED TAVYYCAYRR TGVPRRDAFD NWGQGTMVTV   120
SSASTKGPSV FPLAPSSKS                                                139

M200-F01 LC (SEQ ID NO: 1215)
QDIQMTQSPS TLSASVGDRV TITCRASQSI SSWLAWYQQK PGKAPNLLIY KASTLESGVP    60
SRFSGSGSGT EFTLTISSLQ PDDFATYYCQ QYNTYWTFGQ GTKVEIK                 107

M200-F01 HC (SEQ ID NO: 1216)
EVQLLESGGG LVQPGGSLRL SCAASGFTFS HYIMMWVRQA PGKGLEWVSG IYSSGGITVY    60
ADSVKGRFTI SRDNSKNTLY LQMNSLRAED TAVYYCAYRR MGIPRRNAFD IWGQGTMVTV   120
SSASTKGPSV FPLAPSSKS                                                139

M200-H07 LC (SEQ ID NO: 1217)
QDIQMTQSPS TLSASVGDRV TITCRASQSI SSWLAWYQQK PGKAPNLLIY KASTLESGVP    60
SRFSGSGSGT EFTLTISSLQ PDDFATYYCQ QYNTYWTFGQ GTKVEIK                 107

M200-H07 HC (SEQ ID NO: 1218)
EVQLLESGGG LVQPGGSLRL SCAASGFTFS HYIMMWVRQA PGKGLEWVSG IYSSGGITVY    60
ADSVKGRFTI SRDNSKNTLY LQMNSLRAED TAVYYCAYRR TGVPRRNAFD NWGQGTMVTV   120
SSASTKGPSV FPLAPSSKS                                                139

M201-A06 LC (SEQ ID NO: 1219)
QDIQMTQSPS TLSASVGDRV TITCRASQSI SSWLAWYQQK PGKAPNLLIY KASTLESGVP    60
SRFSGSGSGT EFTLTISSLQ PDDFATYYCQ QYNTYWTFGQ GTKVEIK                 107

M201-A06 HC (SEQ ID NO: 1220)
EVQLLESGGG LVQPGGSLRL SCAASGFTFS HYIMMWVRQA PGKGLEWVSG IYSSGGITVY    60
ADSVKGRFTI SRDNSKNTLY LQMNSLRAED TAVYYCAYRR TGIPRRDVFD IWGQGTMVTV   120
SSASTKGPSV FPLAPSSKS                                                139

M201-A07 LC (SEQ ID NO: 1221)
QDIQMTQSPS TLSASVGDRV TITCRASQSI SSWLAWYQQK PGKAPNLLIY KASTLESGVP    60
SRFSGSGSGT EFTLTISSLQ PDDFATYYCQ QYNTYWTFGQ GTKVEIK                 107

M201-A07 HC (SEQ ID NO: 1222)
EVQLLESGGG LVQPGGSLRL SCAASGFTFS HYIMMWVRQA PGKGLEWVSG IYSSGGITVY    60
ADSVKGRFTI SRDNSKNTLY LQMNSLRAED TAVYYCAYRR TGVPRRDEFD IWGQGTMVTV   120
SSASTKGPSV FPLAPSSKS                                                139

M201-F11 LC (SEQ ID NO: 1223)
QDIQMTQSPS TLSASVGDRV TITCRASQSI SSWLAWYQQK PGKAPNLLIY KASTLESGVP    60
SRFSGSGSGT EFTLTISSLQ PDDFATYYCQ QYNTYWTFGQ GTKVEIK                 107

M201-F11 HC (SEQ ID NO: 1224)
EVQLLESGGG LVQPGGSLRL SCAASGFTFS HYIMMWVRQA PGKGLEWVSG IYSSGGITVY    60
ADSVKGRFTI SRDNSKNTLY LQMNSLRAED TAVYYCAYRR SGIPRRDAFD IWGQGTMVTV   120
SSASTKGPSV FPLAPSSKS                                                139

M201-H06 LC (SEQ ID NO: 1225)
QDIQMTQSPS TLSASVGDRV TITCRASQSI SSWLAWYQQK PGKAPNLLIY KASTLESGVP    60
SRFSGSGSGT EFTLTISSLQ PDDFATYYCQ QYNTYWTFGQ GTKVEIK                 107

M201-H06 HC (SEQ ID NO: 1226)
EVQLLESGGG LVQPGGSLRL SCAASGFTFS HYIMMWVRQA PGKGLEWVSG IYSSGGITVY    60
ADSVKGRFTI SRDNSKNTLY LQMNSLRAED TAVYYCAYRR TGVPRRDAFD IWGQGTMVTV   120
SSASTKGPSV FPLAPSSKS                                                139

M201-H08 LC (SEQ ID NO: 1227)
QDIQMTQSPS TLSASVGDRV TITCRASQSI SSWLAWYQQK PGKAPNLLIY KASTLESGVP    60
SRFSGSGSGT EFTLTISSLQ PDDFATYYCQ QYNTYWTFGQ GTKVEIK                 107

M201-H08 HC (SEQ ID NO: 1228)
EVQLLESGGG LVQPGGSLRL SCAASGFTFS HYIMMWVRQA PGKGLEWVSG IYSSGGITVY    60
ADSVKGRFTI SRDNSKNTLY LQMNSLRAED TAVYYCAYRR TGVPRRDALD NWGQGTMVTV   120
SSASTKGPSV FPLAPSSKS                                                139

M202-A01 LC (SEQ ID NO: 1229)
QDIQMTQSPS TLSASVGDRV TITCRASQSI SSWLAWYQQK PGKAPNLLIY KASTLESGVP    60
SRFSGSGSGT EFTLTISSLQ PDDFATYYCQ QYNTYWTFGQ GTKVEIK                 107

M202-A01 HC (SEQ ID NO: 1230)
EVQLLESGGG LVQPGGSLRL SCAASGFTFS HYIMMWVRQA PGKGLEWVSG IYSSGGITVY    60
ADSVKGRFTI SRDNSKNTLY LQMNSLRAED TAVYYCAYRR IGVPRRDAFD IWGQGTMVTV   120
SSASTKGPSV FPLAPSSKS                                                139

M202-A04 LC (SEQ ID NO: 1231)
QDIQMTQSPS TLSASVGDRV TITCRASQSI SSWLAWYQQK PGKAPNLLIY KASTLESGVP    60
SRFSGSGSGT EFTLTISSLQ PDDFATYYCQ QYNTYWTFGQ GTKVEIK                 107
```

```
M202-A04 HC (SEQ ID NO: 1232)
EVQLLESGGG LVQPGGSLRL SCAASGFTFS HYIMMWVRQA PGKGLEWVSG IYSSGGITVY      60
ADSVKGRFTI SRDNSKNTLY LQMNSLRAED TAVYYCAYRR KGIPRRDDFD IWGQGTMVTV     120
SSASTKGPSV FPLAPSSKS                                                  139

M202-A08 LC (SEQ ID NO: 1233)
QDIQMTQSPS TLSASVGDRV TITCRASQSI SSWLAWYQQK PGKAPNLLIY KASTLESGVP      60
SRFSGSGSGT EFTLTISSLQ PDDFATYYCQ QYNTYWTFGQ GTKVEIK                   107

M202-A08 HC (SEQ ID NO: 1234)
EVQLLESGGG LVQPGGSLRL SCAASGFTFS HYIMMWVRQA PGKGLEWVSG IYSSGGITVY      60
ADSVKGRFTI SRDNSKNTLY LQMNSLRAED TAVYYCAYRR TGIPRWDAFD IWGQGTMVTV     120
SSASTKGPSV FPLAPSSKS                                                  139

M202-A10 LC (SEQ ID NO: 1235)
QDIQMTQSPS TLSASVGDRV TITCRASQSI SSWLAWYQQK PGKAPNLLIY KASTLESGVP      60
SRFSGSGSGT EFTLTISSLQ PDDFATYYCQ QYNTYWTFGQ GTKVEIK                   107

M202-A10 HC (SEQ ID NO: 1236)
EVQLLESGGG LVQPGGSLRL SCAASGFTFS HYIMMWVRQA PGKGLEWVSG IYSSGGITVY      60
ADSVKGRFTI SRDNSKNTLY LQMNSLRAED TAVYYCAFRR TGIPRRDSFD IWGQGTMVTV     120
SSASTKGPSV FPLAPSSKS                                                  139

M202-A12 LC (SEQ ID NO: 1237)
QDIQMTQSPS TLSASVGDRV TITCRASQSI SSWLAWYQQK PGKAPNLLIY KASTLESGVP      60
SRFSGSGSGT EFTLTISSLQ PDDFATYYCQ QYNTYWTFGQ GTKVEIK                   107

M202-A12 HC (SEQ ID NO: 1238)
EVQLLESGGG LVQPGGSLRL SCAASGFTFS HYIMMWVRQA PGKGLEWVSG IYSSGGITVY      60
ADSVKGRFTI SRDNSKNTLY LQMNSLRAED TAVYYCAYQR TGVPRRDSFD IWGQGTMVTV     120
SSASTKGPSV FPLAPSSKS                                                  139

M202-B03 LC (SEQ ID NO: 1239)
QDIQMTQSPS TLSASVGDRV TITCRASQSI SSWLAWYQQK PGKAPNLLIY KASTLESGVP      60
SRFSGSGSGT EFTLTISSLQ PDDFATYYCQ QYNTYWTFGQ GTKVEIK                   107

M202-B03 HC (SEQ ID NO: 1240)
EVQLLESGGG LVQPGGSLRL SCAASGFTFS HYIMMWVRQA PGKGLEWVSG IYSSGGITVY      60
ADSVKGRFTI SRDNSKNTLY LQMNSLRAED TAVYYCAYRR TGVPRRDDFD IWGQGTMVTV     120
SSASTKGPSV FPLAPSSKS                                                  139

M202-B04 LC (SEQ ID NO: 1241)
QDIQMTQSPS TLSASVGDRV TITCRASQSI SSWLAWYQQK PGKAPNLLIY KASTLESGVP      60
SRFSGSGSGT EFTLTISSLQ PDDFATYYCQ QYNTYWTFGQ GTKVEIK                   107

M202-B04 HC (SEQ ID NO: 1242)
EVQLLESGGG LVQPGGSLRL SCAASGFTFS HYIMMWVRQA PGKGLEWVSG IYSSGGITVY      60
ADSVKGRFTI SRDNSKNTLY LQMNSLRAED TAVYYCAYRR SGVPRRDDFD IWGQGTMVTV     120
SSASTKGPSV FPLAPSSKS                                                  139

M202-C01 LC (SEQ ID NO: 1243)
QDIQMTQSPS TLSASVGDRV TITCRASQSI SSWLAWYQQK PGKAPNLLIY KASTLESGVP      60
SRFSGSGSGT EFTLTISSLQ PDDFATYYCQ QYNTYWTFGQ GTKVEIK                   107

M202-C01 HC (SEQ ID NO: 1244)
EVQLLESGGG LVQPGGSLRL SCAASGFTFS HYIMMWVRQA PGKGLEWVSG IYSSGGITVY      60
ADSVKGRFTI SRDNSKNTLY LQMNSLRAED TAVYYCAYRR TGVPRWDDFD IWGQGTMVTV     120
SSASTKGPSV FPLAPSSKS                                                  139

M202-C02 LC (SEQ ID NO: 1245)
QDIQMTQSPS TLSASVGDRV TITCRASQSI SSWLAWYQQK PGKAPNLLIY KASTLESGVP      60
SRFSGSGSGT EFTLTISSLQ PDDFATYYCQ QYNTYWTFGQ GTKVEIK                   107

M202-C02 HC (SEQ ID NO: 1246)
EVQLLESGGG LVQPGGSLRL SCAASGFTFS HYIMMWVRQA PGKGLEWVSG IYSSGGITVY      60
ADSVKGRFTI SRDNSKNTLY LQMNSLRAED TAVYYCAYRR PGVPRRDAFD IWGQGTMVTV     120
SSASTKGPSV FPLAPSSKS                                                  139

M202-C09 LC (SEQ ID NO: 1247)
QDIQMTQSPS TLSASVGDRV TITCRASQSI SSWLAWYQQK PGKAPNLLIY KASTLESGVP      60
SRFSGSGSGT EFTLTISSLQ PDDFATYYCQ QYNTYWTFGQ GTKVEIK                   107

M202-C09 HC (SEQ ID NO: 1248)
EVQLLESGGG LVQPGGSLRL SCAASGFTFS HYIMMWVRQA PGKGLEWVSG IYSSGGITVY      60
ADSVKGRFTI SRDNSKNTLY LQMNSLRAED TAVYYCAYRR IGVPRRDDFD IWGQGTMVTV     120
SSASTKGPSV FPLAPSSKS                                                  139

M202-D09 LC (SEQ ID NO: 1249)
QDIQMTQSPS TLSASVGDRV TITCRASQSI SSWLAWYQQK PGKAPNLLIY KASTLESGVP      60
SRFSGSGSGT EFTLTISSLQ PDDFATYYCQ QYNTYWTFGQ GTKVEIK                   107
```

-continued

```
M202-D09 HC (SEQ ID NO: 1250)
EVQLLESGGG LVQPGGSLRL SCAASGFTFS HYIMMWVRQA PGKGLEWVSG IYSSGGITVY      60
ADSVKGRFTI SRDNSKNTLY LQMNSLRAED TAVYYCAYRR IGVPRRDSFD IWGQGTMVTV     120
SSASTKGPSV FPLAPSSKS                                                  139

M202-E03 LC (SEQ ID NO: 1251)
QDIQMTQSPS TLSASVGDRV TITCRASQSI SSWLAWYQQK PGKAPNLLIY KASTLESGVP      60
SRFSGSGSGT EFTLTISSLQ PDDFATYYCQ QYNTYWTFGQ GTKVEIK                   107

M202-E03 HC (SEQ ID NO: 1252)
EVQLLESGGG LVQPGGSLRL SCAASGFTFS HYIMMWVRQA PGKGLEWVSG IYSSGGITVY      60
ADSVKGRFTI SRDNSKNTLY LQMNSLRAED TAVYYCAYRR TGIPRRDAFE IWGQGTMVTV     120
SSASTKGPSV FPLAPSSKS                                                  139

M202-E06 LC (SEQ ID NO: 1253)
QDIQMTQSPS TLSASVGDRV TITCRASQSI SSWLAWYQQK PGKAPNLLIY KASTLESGVP      60
SRFSGSGSGT EFTLTISSLQ PDDFATYYCQ QYNTYWTFGQ GTKVEIK                   107

M202-E06 HC (SEQ ID NO: 1254)
EVQLLESGGG LVQPGGSLRL SCAASGFTFS HYIMMWVRQA PGKGLEWVSG IYSSGGITVY      60
ADSVKGRFTI SRDNSKNTLY LQMNSLRAED TAVYYCAYRR RGVPRRDDFD IWGQGTMVTV     120
SSASTKGPSV FPLAPSSKS                                                  139

M202-F06 LC (SEQ ID NO: 1255)
QDIQMTQSPS TLSASVGDRV TITCRASQSI SSWLAWYQQK PGKAPNLLIY KASTLESGVP      60
SRFSGSGSGT EFTLTISSLQ PDDFATYYCQ QYNTYWTFGQ GTKVEIK                   107

M202-F06 HC (SEQ ID NO: 1256)
EVQLLESGGG LVQPGGSLRL SCAASGFTFS HYIMMWVRQA PGKGLEWVSG IYSSGGITVY      60
ADSVKGRFTI SRDNSKNTLY LQMNSLRAED TAVYYCAYRR TGVPRWDAFD IWGQGTMVTV     120
SSASTKGPSV FPLAPSSKS                                                  139

M202-G03 LC (SEQ ID NO: 1257)
QDIQMTQSPS TLSASVGDRV TITCRASQSI SSWLAWYQQK PGKAPNLLIY KASTLESGVP      60
SRFSGSGSGT EFTLTISSLQ PDDFATYYCQ QYNTYWTFGQ GTKVEIK                   107

M202-G03 HC (SEQ ID NO: 1258)
EVQLLESGGG LVQPGGSLRL SCAASGFTFS HYIMMWVRQA PGKGLEWVSG IYSSGGITVY      60
ADSVKGRFTI SRDNSKNTLY LQMNSLRAED TAVYYCAFRR TGVPRRDSFE IWGQGTMVTV     120
SSASTKGPSV FPLAPSSKS                                                  139

M202-H03 LC (SEQ ID NO: 1259)
QDIQMTQSPS TLSASVGDRV TITCRASQSI SSWLAWYQQK PGKAPNLLIY KASTLESGVP      60
SRFSGSGSGT EFTLTISSLQ PDDFATYYCQ QYNTYWTFGQ GTKVEIK                   107

M202-H03 HC (SEQ ID NO: 1260)
EVQLLESGGG LVQPGGSLRL SCAASGFTFS HYIMMWVRQA PGKGLEWVSG IYSSGGITVY      60
ADSVKGRFTI SRDNSKNTLY LQMNSLRAED TAVYYCAFRR TGVPRWDDFD IWGQGTMVTV     120
SSASTKGPSV FPLAPSSKS                                                  139

M202-H05 LC (SEQ ID NO: 1261)
QDIQMTQSPS TLSASVGDRV TITCRASQSI SSWLAWYQQK PGKAPNLLIY KASTLESGVP      60
SRFSGSGSGT EFTLTISSLQ PDDFATYYCQ QYNTYWTFGQ GTKVEIK                   107

M202-H05 HC (SEQ ID NO: 1262)
EVQLLESGGG LVQPGGSLRL SCAASGFTFS HYIMMWVRQA PGKGLEWVSG IYSSGGITVY      60
ADSVKGRFTI SRDNSKNTLY LQMNSLRAED TAVYYCAFRR TGVPRRDVFD IWGQGTMVTV     120
SSASTKGPSV FPLAPSSKS                                                  139
```

TABLE 13

Sequences of Antibodies Obtained from CDR1/2 and CDR3 Spiking Affinity Maturation Libraries Based on X63-G06

| Antibody I.D. | % inhibition at 10 nM | human pKal Ki, app (nM) | LV-CDR1 (SEQ ID NOS 1263-1324, respectively, in order of appearance) | LV-CDR2 (SEQ ID NOS 1325-1386, respectively, in order of appearance) | LV-CDR3 (SEQ ID NOS 1387-1448, respectively, in order of appearance) | HV-CDR1 (SEQ ID NOS 1449-1510, respectively, in order of appearance) | HV-CDR2 (SEQ ID NOS 1511-1572, respectively, in order of appearance) | (SEQ ID NOS 1573-1634, respectively, in order of appearance) HV-CDR3 |
|---|---|---|---|---|---|---|---|---|
| M209-F04 | 97.6 | 0.09 | RTSQFVNSNYLA | GASSRAT | QQSSRTPWT | HYLMT | YISPSGGHTIYADSVKG | VARGIAARSRTSYLDq |
| M209-C11 | 96.2 | 0.14 | RTSQFVNSNYLA | GASSRAT | QQSSRTPWT | HYLMT | YISPSGGHTIYADSVKG | VGQGIRGRSRTSYFAq |

TABLE 13-continued

Sequences of Antibodies Obtained from CDR1/2 and CDR3 Spiking Affinity Maturation Libraries Based on X63-G06

| Antibody I.D. | % inhibition at 10 nM | human pKal Ki, app (nM) | LV-CDR1 (SEQ ID NOS 1263-1324, respectively, in order of appearance) | LV-CDR2 (SEQ ID NOS 1325-1386, respectively, in order of appearance) | LV-CDR3 (SEQ ID NOS 1387-1448, respectively, in order of appearance) | HV-CDR1 (SEQ ID NOS 1449-1510, respectively, in order of appearance) | HV-CDR2 (SEQ ID NOS 1511-1572, respectively, in order of appearance) | (SEQ ID NOS 1573-1634, respectively, in order of appearance) HV-CDR3 |
|---|---|---|---|---|---|---|---|---|
| M206-H08 | 96.0 | 0.17 | RTSQFVNSNYLA | GASSRAT | QQSSRTPWT | DYMMA | SIVPSGGHTHYADSVKG | VARGIAARSRTSYFDY |
| M210-C12 | 95.6 | 0.16 | RTSQFVNSNYLA | GASSRAT | QQSSRTPWT | HYLMT | YISPSGGHTIYADSVKG | VAQGIAARSRTSSVDq |
| M208-F04 | 95.4 | 0.2 | RTSQFVNSNYLA | GASSRAT | QQSSRTPWT | HYLMT | YISPSGGHTIYADSVKG | VARGIAARSRTSFFDY |
| M206-B10 | 94.7 | 0.3 | RTSQFVNSNYLA | GASSRAT | QQSSRTPWT | qYLMA | SIYPSGGWTKYADSVKG | VARGIAARSRTSYFDY |
| M208-H02 | 94.4 | 0.2 | RTSQFVNSNYLA | GASSRAT | QQSSRTPWT | HYLMT | YISPSGGHTIYADSVKG | VARGIASRSRTRYCDY |
| M210-G04 | 94.2 | 0.3 | RTSQFVNSNYLA | GASSRAT | QQSSRTPWT | HYLMT | YISPSGGHTIYADSVKG | VATGIVARSRTRYFDq |
| M210-H06 | 93.8 | 0.2 | RTSQFVNSNYLA | GASSRAT | QQSSRTPWT | HYLMT | YISPSGGHTIYADSVKG | VARGIAARSRTRYFDY |
| M208-E10 | 93.7 | 0.09 | RTSQFVNSNYLA | GASSRAT | QQSSRTPWT | HYLMT | YISPSGGHTIYADSVKG | VAQGISARSRTSYFDY |
| M209-B09 | 93.5 | 0.2 | RTSQFVNSNYLA | GASSRAT | QQSSRTPWT | HYLMT | YISPSGGHTIYADSVKG | VAQGIVARSRTSYLHq |
| M209-C12 | 93.4 | | RTSQFVNSNYLA | GASSRAT | QQSSRTPWT | HYLMT | YISPSGGHTIYADSVKG | VGRGIAARSRTSqLDY |
| M208-G03 | 93.4 | 0.3 | RTSQFVNSNYLA | GASSRAT | QQSSRTPWT | HYLMT | YISPSGGHTIYADSVKG | VARGIAARSRTSYLDY |
| M206-A06 | 93.0 | | RTSQFVNSNYLA | GASSRAT | QQSSRTPWT | NYMMG | SISPSGGLTKYADSVKG | VARGIAARSRTSYFDY |
| M210-H07 | 92.8 | 0.4 | RTSQFVNSNYLA | GASSRAT | QQSSRTPWT | HYLMT | YISPSGGHTIYADSVKG | VARGIAARSRTRYFDq |
| M206-F01 | 92.6 | 0.2 | RTSQFVNSNYLA | GASSRAT | QQSSRTPWT | GYMMV | RISPSGGPTIYADSVKG | VARGIAARSRTSYFDY |
| M208-F10 | 92.5 | 0.2 | RTSQFVNSNYLA | GASSRAT | QQSSRTPWT | HYLMT | YISPSGGHTIYADSVKG | VARGIAARSRTSYFDq |
| M209-E02 | 92.4 | 0.3 | RTSQFVNSNYLA | GASSRAT | QQSSRTPWT | HYLMT | YISPSGGHTIYADSVKG | VARGIAARSRTILLDq |
| M208-C06 | 91.7 | 0.4 | RTSQFVNSNYLA | GASSRAT | QQSSRTPWT | HYLMT | YISPSGGHTIYADSVKG | VARGIAARSRTSFIDY |
| M205-D04 | 91.5 | 0.4 | RTSQFVNSNYLA | GASSRAT | QQSSRTPWT | TYKMq | SISPSGGPTNYADSVKG | VARGIAARSRTSYFDY |
| M210-G10 | 91.2 | 0.4 | RTSQFVNSNYLA | GASSRAT | QQSSRTPWT | HYLMT | YISPSGGHTIYADSVKG | VARGIAARSRTSYLDF |
| M207-A04 | 90.9 | | RTSQFVNSNYLA | GASSRAT | QQSSRTPWT | HYLMT | YISPSGGHTIYADSVKG | VARGIAARSRTRSFDY |
| M210-B02 | 90.9 | 0.2 | RTSQFVNSNYLA | GASSRAT | QQSSRTPWT | HYLMT | YISPSGGHTIYADSVKG | VARGIAARSRTSYFNq |
| M208-B01 | 90.1 | | RTSQFVNSNYLA | GASSRAT | QQSSRTPWT | HYLMT | YISPSGGHTIYADSVKG | VARGIAARSRTSFFDq |
| M209-G07 | 89.8 | | RTSQFVNSNYLA | GASSRAT | QQSSRTPWT | HYLMT | YISPSGGHTIYADSVKG | VARGIAARSRTSYFDT |

TABLE 13-continued

Sequences of Antibodies Obtained from CDR1/2 and CDR3 Spiking Affinity Maturation Libraries Based on X63-G06

| Antibody I.D. | % inhibition at 10 nM | human pKal Ki, app (nM) | LV-CDR1 (SEQ ID NOS 1263-1324, respectively, in order of appearance) | LV-CDR2 (SEQ ID NOS 1325-1386, respectively, in order of appearance) | LV-CDR3 (SEQ ID NOS 1387-1448, respectively, in order of appearance) | HV-CDR1 (SEQ ID NOS 1449-1510, respectively, in order of appearance) | HV-CDR2 (SEQ ID NOS 1511-1572, respectively, in order of appearance) | (SEQ ID NOS 1573-1634, respectively, in order of appearance) HV-CDR3 |
|---|---|---|---|---|---|---|---|---|
| M204-A02 | 89.5 | | RTSQFVNSNYLA | GASSRAT | QQSSRTPWT | DYMMT | YISPSGGLTSYADSVKG | VARGIAARSRTSYFDY |
| M206-H01 | 87.6 | | RTSQFVNSNYLA | GASSRAT | QQSSRTPWT | EYMMV | RISPSGGTTEYADSVKG | VARGIAARSRTSYFDY |
| M209-B11 | 87.3 | | RTSQFVNSNYLA | GASSRAT | QQSSRTPWT | HYLMT | YISPSGGHTIYADSVKG | VARGIAARSRTRYIDq |
| M206-F09 | 86.8 | | RTSQFVNSNYLA | GASSRAT | QQSSRTPWT | VYMMS | SIVPSGGSTTYADSVKG | VARGIAARSRTSYFDY |
| M209-C02 | 86.8 | | RTSQFVNSNYLA | GASSRAT | QQSSRTPWT | HYLMT | YISPSGGHTIYADSVKG | VARGIAYRRRTSYFDY |
| M208-G02 | 86.7 | | RTSQFVNSNYLA | GASSRAT | QQSSRTPWT | HYLMT | YISPSGGHTIYADSVKG | VARGIADRSRTSYSDY |
| M205-C11 | 86.5 | | RTSQFVNSNYLA | GASSRAT | QQSSRTPWT | QYMMM | RISPSGGSTLYADSVKG | VARGIAARSRTSYFDY |
| M205-H08 | 85.9 | | RTSQFVNSNYLA | GASSRAT | QQSSRTPWT | DYMMM | SIVPSGGHTqYADSVKG | VARGIAARSRTSYFDY |
| M210-H01 | 85.5 | | RTSQFVNSNYLA | GASSRAT | QQSSRTPWT | HYLMT | YISPSGGHTIYADSVKG | VARGIAARSRNSqQDY |
| M209-D12 | 85.4 | | RTSQFVNSNYLA | GASSRAT | QQSSRTPWT | HYLMT | YISPSGGHTIYADSVKG | VARGIAARSRTSYFDq |
| M209-H09 | 85.3 | | RTSQFVNSNYLA | GASSRAT | QQSSRTPWT | HYLMT | YISPSGGHTIYADSVKG | VARGIAARSRTVYFDH |
| M204-E12 | 84.1 | | RTSQFVNSNYLA | GASSRAT | QQSSRTPWT | TYMMq | YIGPSGGKTDYADSVKG | VARGIAARSRTSYFDY |
| M209-H03 | 82.6 | | RTSQFVNSNYLA | GASSRAT | QQSSRTPWT | HYLMT | YISPSGGHTIYADSVKG | VAQGIAARSRTTqFDY |
| M206-H05 | 82.5 | | RTSQFVNSNYLA | GASSRAT | QQSSRTPWT | GYKMq | SISPSGGITMYADSVKG | VARGIAARSRTSYFDY |
| M209-D03 | 80.4 | | RTSQFVNSNYLA | GASSRAT | QQSSRTPWT | HYLMT | YISPSGGHTIYADSVKG | VGRGIAARSRTSFFDq |
| M205-A02 | 80.3 | | RTSQFVNSNYLA | GASSRAT | QQSSRTPWT | TYLMA | GIVSSGGRTLYADSVKG | VARGIAARSRTSYFDY |
| M208-A10 | 78.5 | | RTSQFVNSNYLA | GASSRAT | QQSSRTPWT | HYLMT | YISPSGGHTIYADSVKG | VARGIAARSRTSqFDH |
| M205-E11 | 78.2 | | RTSQFVNSNYLA | GASSRAT | QQSSRTPWT | NYTMG | SISPSGGKTDYADSVKG | VARGIAARSRTSYFDY |
| M206-E02 | 77.6 | | RTSQFVNSNYLA | GASSRAT | QQSSRTPWT | EYMMM | VISPSGGQTHYADSVKG | VARGIAARSRTSYFDY |
| M205-H01 | 77.1 | | RTSQFVNSNYLA | GASSRAT | QQSSRTPWT | NYTMQ | YISPSGGYTGYADSVKG | VARGIAARSRTSYFDY |
| M207-A02 | 76.6 | | RTSQFVNSNYLA | GASSRAT | QQSSRTPWT | HYLMT | YISPSGGHTIYADSVKG | VARGIAARSRTINLDY |
| M209-H07 | 76.1 | | RTSQFVNSNYLA | GASSRAT | QQSSRTPWT | HYLMT | YISPSGGHTIYADSVKG | VARGIAARqRTSYYDY |
| M209-G01 | 74.8 | | RTSQFVNSNYLA | GASSRAT | QQSSRTPWT | HYLMT | YISPSGGHTIYADSVKG | VAqGISGRSRLSYVDY |

TABLE 13-continued

Sequences of Antibodies Obtained from CDR1/2 and CDR3 Spiking Affinity Maturation Libraries Based on X63-G06

| Antibody I.D. | % inhibition at 10 nM | human pKal Ki, app (nM) | LV-CDR1 (SEQ ID NOS 1263-1324, respectively, in order of appearance) | LV-CDR2 (SEQ ID NOS 1325-1386, respectively, in order of appearance) | LV-CDR3 (SEQ ID NOS 1387-1448, respectively, in order of appearance) | HV-CDR1 (SEQ ID NOS 1449-1510, respectively, in order of appearance) | HV-CDR2 (SEQ ID NOS 1511-1572, respectively, in order of appearance) | (SEQ ID NOS 1573-1634, respectively, in order of appearance) HV-CDR3 |
|---|---|---|---|---|---|---|---|---|
| M210-A06 | 74.8 | | RTSQFVNSNYLA | GASSRAT | QQSSRTPWT | HYLMT | YISPSGGHTIYADSVKG | VARGIAARSRTSqFDY |
| M209-D02 | 74.7 | | RTSQFVNSNYLA | GASSRAT | QQSSRTPWT | HYLMT | YISPSGGHTIYADSVKG | VARGITARSRTSYFDD |
| M205-B04 | 71.1 | | RTSQFVNSNYLA | GASSRAT | QQSSRTPWT | NYDMI | SISSSGGTTKYADSVKG | VARGIAARSRTSYFDY |
| M203-A03 | 69.1 | | RTSQFVNSNYLA | GASSRAT | QQSSRTPWT | VYMMI | SISPSGGQTTYADSVKG | VARGIAARSRTSYFDY |
| M209-E03 | 68.8 | | RTSQFVNSNYLA | GASSRAT | QQSSRTPWT | HYLMT | YISPSGGHTIYADSVKG | qARGIAARSRTSYFDY |
| M207-A01 | 67.2 | | RTSQFVNSNYLA | GASSRAT | QQSSRTPWT | HYLMT | YISPSGGHTIYADSVKG | VARGISARSRTSCFDY |
| M206-C03 | 65.5 | | RTSQFVNSNYLA | GASSRAT | QQSSRTPWT | qYMMV | SIYSSGGNTPYADSVKG | VARGIAARSRTSYFDY |
| M207-C05 | 61.4 | | RTSQFVNSNYLA | GASSRAT | QQSSRTPWT | HYLMT | YISPSGGHTIYADSVKG | VGRGIAARSRTSYFDK |
| M205-A12 | 58.8 | | RTSQFVNSNYLA | GASSRAT | QQSSRTPWT | QYDMI | YISSSGGFTRYADSVKG | VARGIAARSRTSYFDY |
| M205-F03 | 58.6 | | RTSQFVNSNYLA | GASSRAT | QQSSRTPWT | SqQMV | YISPSGGNTYYADSVKG | VARGIAARSRTSYFDY |
| M203-A01 | 51.4 | | RTSQFVNSNYLA | GASSRAT | QQSSRTPWT | NYLMA | WIVPSGGYTEYADSVKG | VARGIAARSRTSYFDY |
| M209-B01 | 47.0 | | RTSQFVNSNYLA | GASSRAT | QQSSRTPWT | HYLMT | YISPSGGHTIYADSVKG | VARGIVARSRTSNFDq |
| M208-D12 | 43.7 | | RTSQFVNSNYLA | GASSRAT | QQSSRTPWT | HYLMT | YISPSGGHTIYADSVKG | LARGIAARSRTSYqDI |
| M206-H04 | 19.0 | | RTSQFVNSNYLA | GASSRAT | QQSSRTPWT | SYMMV | SISPSGGYTIqADSVKG | VARGIAARSRTSYFDY |

Amino acid sequences of light chain (LC) and heavy chain (HC) variable domain of pKal antibodies obtained from CDR1/2 and CDR3 spiking affinity maturation libraries based on X63-G06.

```
M203-A01 LC (SEQ ID NO: 1635)
QDIQMTQSPS TLSLSPGERA TLSCRTSQFV NSNYLAWYQQ TPGQAPRLLI YGASSRATGI     60
PDRFSGTGYG TDFTLTISRL EPEDYGTYYC QQSSRTPWTF GQGTRVEIK                109

M203-A01 HC (SEQ ID NO: 1636)
EVQLLESGGG LVQPGGSLRL SCAASGFTFS NYLMAWVRQA PGKGLEWVSW IVPSGGYTEY     60
ADSVKGRFTI SRDNSKNTLY LQMNSLRAED TAVYYCARVA RGIAARSRTS YFDYWGQGTL    120
VTVSSASTKG PSVFPLAPSS KS                                             142

M203-A03 LC (SEQ ID NO: 1637)
QDIQMTQSPG TLSLSPGERA TLSCRTSQFV NSNYLAWYQQ TPGQAPRLLI YGASSRATGI     60
PDRFSGTGYG TDFTLTISRL EPEDYGTYYC QQSSRTPWTF GQGTRVEIK                109

M203-A03 HC (SEQ ID NO: 1638)
EVQLLESGGG LVQPGGSLRL SCAASGFTFS VYMMIWVRQA PGKGLEWVSS ISPSGGQTTY     60
ADSVKGRFTI SRDNSKNTLY LQMNSLRAED TAVYYCARVA RGIAARSRTS YFDYWGQGTL    120
VTVSSASTKG PSVFPLAPSS KS                                             142
```

```
M204-A02 LC (SEQ ID NO: 1639)
QDIQMTQSPG TLSLSPGERA TLSCRTSQFV NSNYLAWYQQ TPGQAPRLLI YGASSRATGI    60
PDRFSGTGYG TDFTLTISRL EPEDYGTYYC QQSSRTPWTF GQGTRVEIK              109

M204-A02 HC (SEQ ID NO: 1640)
EVQLLESGGG LVQPGGSLRL SCAASGFTFS DYMMTWVRQA PGKGLqWVSY ISPSGGLTSY    60
ADSVKGRFTI SRDNSKNTLY LQMNSLRAED TAVYYCARVA RGIAARSRTS YFDYWGQGTL   120
VTVSSASTKG PSVFPLAPSS KS                                           142

M204-E12 LC (SEQ ID NO: 1641)
QDIQMTQSPG TLSLSPGERA TLSCRTSQFV NSNYLAWYQQ TPGQAPRLLI YGASSRATGI    60
PDRFSGTGYG TDFTLTISRL EPEDYGTYYC QQSSRTPWTF GQGTRVEIK              109

M204-E12 HC (SEQ ID NO: 1642)
EVQLLESGGG LVQPGGSLRL SCAASGFTFS TYMMqWVRQA PGKGLEWVSY IGPSGGKTDY    60
ADSVKGRFTI SRDNSKNTLY LQMNSLRAED TAVYYCARVA RGIAARSRTS YFDYWGQGTL   120
VTVSSASTKG PSVFPLAPSS KS                                           142

M205-A02 LC (SEQ ID NO: 1643)
QDIQMTQSPG TLSLSPGERA TLSCRTSQFV NSNYLAWYQQ TPGQAPRLLI YGASSRATGI    60
PDRFSGTGYG TDFTLTISRL EPEDYGTYYC QQSSRTPWTF GQGTRVEIK              109

M205-A02 HC (SEQ ID NO: 1644)
EVQLLESGGG LVQPGGSLRL SCAASGFTFS TYLMAWVRQA PGKGLEWVSG IVSSGGRTLY    60
ADSVKGRFTI SRDNSKNTLY LQMNSLRAED TAVYYCARVA RGIAARSRTS YFDYWGQGTL   120
VTVSSASTKG PSVFPLAPSS KS                                           142

M205-A12 LC (SEQ ID NO: 1645)
QDIQMTQSPG TLSLSPGERA TLSCRTSQFV NSNYLAWYQQ TPGQAPRLLI YGASSRATGI    60
PDRFSGTGYG TDFTLTISRL EPEDYGTYYC QQSSRTPWTF GQGTRVEIK              109

M205-A12 HC (SEQ ID NO: 1646)
EVQLLESGGG LVQPGGSLRL SCAASGFTFS QYDMIWVRQA PGKGLEWVSY ISSSGGFTRY    60
ADSVKGRFTI SRDNSKNTLY LQMNSLRAED TAVYYCARVA RGIAARSRTS YFDYWGQGTL   120
VTVSSASTKG PSVFPLAPSS KS                                           142

M205-B04 LC (SEQ ID NO: 1647)
QDIQMTQSPG TLSLSPGERA TLSCRTSQFV NSNYLAWYQQ TPGQAPRLLI YGASSRATGI    60
PDRFSGTGYG TDFTLTISRL EPEDYGTYYC QQSSRTPWTF GQGTRVEIK              109

M205-B04 HC (SEQ ID NO: 1648)
EVQLLESGGG LVQPGGSLRL SCAASGFTFS NYDMIWVRQA PGKGLEWVSS ISSSGGTTKY    60
ADSVKGRFTI SRDNSKNTLY LQMNSLRAED TAVYYCARVA RGIAARSRTS YFDYWGQGTL   120
VTVSSASTKG PSVFPLAPSS KS                                           142

M205-C11 LC (SEQ ID NO: 1649)
QDIQMTQSPG TLSLSPGERA TLSCRTSQFV NSNYLAWYQQ TPGQAPRLLI YGASSRATGI    60
PDRFSGTGYG TDFTLTISRL EPEDYGTYYC QQSSRTPWTF GQGTRVEIK              109

M205-C11 HC (SEQ ID NO: 1650)
EVQLLESGGG LVQPGGSLRL SCAASGFTFS QYMMMWVRQA PGKGLEWVSR ISPSGGSTLY    60
ADSVKGRFTI SRDNSKNTLY LQMNSLRAED TAVYYCARVA RGIAARSRTS YFDYWGQGTL   120
VTVSSASTKG PSVFPLAPSS KS                                           142

M205-D04 LC (SEQ ID NO: 1651)
QDIQMTQSPG TLSLSPGERA TLSCRTSQFV NSNYLAWYQQ TPGQAPRLLI YGASSRATGI    60
PDRFSGTGYG TDFTLTISRL EPEDYGTYYC QQSSRTPWTF GQGTRVEIK              109

M205-D04 HC (SEQ ID NO: 1652)
EVQLLESGGG LVQPGGSLRL SCAASGFTFS TYKMqWVRQA PGKGLEWVSS ISPSGGPTNY    60
ADSVKGRFTI SRDNSKNTLY LQMNSLRAED TAVYYCARVA RGIAARSRTS YFDYWGQGTL   120
VTVSSASTKG PSVFPLAPSS KS                                           142

M205-E11 LC (SEQ ID NO: 1653)
QDIQMTQSPG TLSLSPGERA TLSCRTSQFV NSNYLAWYQQ TPGQAPRLLI YGASSRATGI    60
PDRFSGTGYG TDFTLTISRL EPEDYGTYYC QQSSRTPWTF GQGTRVEIK              109

M205-E11 HC (SEQ ID NO: 1654)
EVQLLESGGG LVQPGGSLRL SCAASGFTFS NYTMGWVRQA PGKGLEWVSS ISPSGGKTDY    60
ADSVKGRFTI SRDNSKNTLY LQMNSLRAED TAVYYCARVA RGIAARSRTS YFDYWGQGTL   120
VTVSSASTKG PSVFPLAPSS KS                                           142

M205-F03 LC (SEQ ID NO: 1655)
QDIQMTQSPG TLSLSPGERA TLSCRTSQFV NSNYLAWYQQ TPGQAPRLLI YGASSRATGI    60
PDRFSGTGYG TDFTLTISRL EPEDYGTYYC QQSSRTPWTF GQGTRVEIK              109

M205-F03 HC (SEQ ID NO: 1656)
EVQLLESGGG LVQPGGSLRL SCAASGFTFS SqQMVWVRQA PGKGLEWVSY ISPSGGNTYY    60
ADSVKGRFTI SRDNSKNTLY LQMNSLRAED TAVYYCARVA RGIAARSRTS YFDYWGQGTL   120
VTVSSASTKG PSVFPLAPSS KS                                           142
```

```
M205-H01 LC (SEQ ID NO: 1657)
QDIQMTQSPG TLSLSPGERA TLSCRTSQFV NSNYLAWYQQ TPGQAPRLLI YGASSRATGI    60
PDRFSGTGYG TDFTLTISRL EPEDYGTYYC QQSSRTPWTF GQGTRVEIK              109

M205-H01 HC (SEQ ID NO: 1658)
EVQLLESGGG LVQPGGSLRL SCAASGFTFS NYTMQWVRQA PGKGLqWVSY ISPSGGYTGY    60
ADSVKGRFTI SRDNSKNTLY LQMNSLRAED TAVYYCARVA RGIAARSRTS YFDYWGQGTL   120
VTVSSASTKG PSVFPLAPSS KS                                           142

M205-H08 LC (SEQ ID NO: 1659)
QDIQMTQSPG TLSLSPGERA TLSCRTSQFV NSNYLAWYQQ TPGQAPRLLI YGASSRATGI    60
PDRFSGTGYG TDFTLTISRL EPEDYGTYYC QQSSRTPWTF GQGTRVEIK              109

M205-H08 HC (SEQ ID NO: 1660)
EVQLLESGGG LVQPGGSLRL SCAASGFTFS DYMMMWVRQA PGKGLEWVSS IVPSGGHTqY    60
ADSVKGRFTI SRDNSKNTLY LQMNSLRAED TAVYYCARVA RGIAARSRTS YFDYWGQGTL   120
VTVSSASTKG PSVFPLAPSS KS                                           142

M206-A06 LC (SEQ ID NO: 1661)
QDIQMTQSPG TLSLSPGERA TLSCRTSQFV NSNYLAWYQQ TPGQAPRLLI YGASSRATGI    60
PDRFSGTGYG TDFTLTISRL EPEDYGTYYC QQSSRTPWTF GQGTRVEIK              109

M206-A06 HC (SEQ ID NO: 1662)
EVQLLESGGG LVQPGGSLRL SCAASGFTFS NYMMGWVRQA PGKGLqWVSS ISPSGGLTKY    60
ADSVKGRFTI SRDNSKNTLY LQMNSLRAED TAVYYCARVA RGIAARSRTS YFDYWGQGTL   120
VTVSSASTKG PSVFPLAPSS KS                                           142

M206-B10 LC (SEQ ID NO: 1663)
QDIQMTQSPG TLSLSPGERA TLSCRTSQFV NSNYLAWYQQ TPGQAPRLLI YGASSRATGI    60
PDRFSGTGYG TDFTLTISRL EPEDYGTYYC QQSSRTPWTF GQGTRVEIK              109

M206-B10 HC (SEQ ID NO: 1664)
EVQLLESGGG LVQPGGSLRL SCAASGFTFS qYLMAWVRQA PGKGLEWVSS IYPSGGWTKY    60
ADSVKGRFTI SRDNSKNTLY LQMNSLRAED TAVYYCARVA RGIAARSRTS YFDYWGQGTL   120
VTVSSASTKG PSVFPLAPSS KS                                           142

M206-C03 LC (SEQ ID NO: 1665)
QDIQMTQSPG TLSLSPGERA TLSCRTSQFV NSNYLAWYQQ TPGQAPRLLI YGASSRATGI    60
PDRFSGTGYG TDFTLTISRL EPEDYGTYYC QQSSRTPWTF GQGTRVEIK              109

M206-C03 HC (SEQ ID NO: 1666)
EVQLLESGGG LVQPGGSLRL SCAASGFTFS qYMMVWVRQA PGKGLEWVSS IYSSGGNTPY    60
ADSVKGRFTI SRDNSKNTLY LQMNSLRAED TAVYYCARVA RGIAARSRTS YFDYWGQGTL   120
VTVSSASTKG PSVFPLAPSS KS                                           142

M206-E02 LC (SEQ ID NO: 1667)
QDIQMTQSPG TLSLSPGERA TLSCRTSQFV NSNYLAWYQQ TPGQAPRLLI YGASSRATGI    60
PDRFSGTGYG TDFTLTISRL EPEDYGTYYC QQSSRTPWTF GQGTRVEIK              109

M206-E02 HC (SEQ ID NO: 1668)
EVQLLESGGG LVQPGGSLRL SCAASGFTFS EYMMMWVRQA PGKGLEWVSV ISPSGGQTHY    60
ADSVKGRFTI SRDNSKNTLY LQMNSLRAED TAVYYCARVA RGIAARSRTS YFDYWGQGTL   120
VTVSSASTKG PSVFPLAPSS KS                                           142

M206-F01 LC (SEQ ID NO: 1669)
QDIQMTQSPG TLSLSPGERA TLSCRTSQFV NSNYLAWYQQ TPGQAPRLLI YGASSRATGI    60
PDRFSGTGYG TDFTLTISRL EPEDYGTYYC QQSSRTPWTF GQGTRVEIK              109

M206-F01 HC (SEQ ID NO: 1670)
EVQLLESGGG LVQPGGSLRL SCAASGFTFS GYMMGWVRQA PGKGLEWVSR ISPSGGPTIY    60
ADSVKGRFTI SRDNSKNTLY LQMNSLRAED TAVYYCARVA RGIAARSRTS YFDYWGQGTL   120
VTVSSASTKG PSVFPLAPSS KS                                           142

M206-F09 LC (SEQ ID NO: 1671)
QDIQMTQSPG TLSLSPGERA TLSCRTSQFV NSNYLAWYQQ TPGQAPRLLI YGASSRATGI    60
PDRFSGTGYG TDFTLTISRL EPEDYGTYYC QQSSRTPWTF GQGTRVEIK              109

M206-F09 HC (SEQ ID NO: 1672)
EVQLLESGGG LVQPGGSLRL SCAASGFTFS VYMMSWVRQA PGKGLEWVSS IVPSGGSTTY    60
ADSVKGRFTI SRDNSKNTLY LQMNSLRAED TAVYYCARVA RGIAARSRTS YFDYWGQGTL   120
VTVSSASTKG PSVFPLAPSS KS                                           142

M206-H01 LC (SEQ ID NO: 1673)
QDIQMTQSPG TLSLSPGERA TLSCRTSQFV NSNYLAWYQQ TPGQAPRLLI YGASSRATGI    60
PDRFSGTGYG TDFTLTISRL EPEDYGTYYC QQSSRTPWTF GQGTRVEIK              109

M206-H01 HC (SEQ ID NO: 1674)
EVQLLESGGG LVQPGGSLRL SCAASGFTFS EYMMVWVRQA PGKGLEWVSR ISPSGGTTEY    60
ADSVKGRFTI SRDNSKNTLY LQMNSLRAED TAVYYCARVA RGIAARSRTS YFDYWGQGTL   120
VTVSSASTKG PSVFPLAPSS KS                                           142
```

```
M206-H04 LC (SEQ ID NO: 1675)
QDIQMTQSPG TLSLSPGERA TLSCRTSQFV NSNYLAWYQQ TPGQAPRLLI YGASSRATGI    60
PDRFSGTGYG TDFTLTISRL EPEDYGTYYC QQSSRTPWTF GQGTRVEIK               109

M206-H04 HC (SEQ ID NO: 1676)
EVQLLESGGG LVQPGGSLRL SCAASGFTFS SYMMVWVRQA PGKGLEWVSS ISPSGGYTIq    60
ADSVKGRFTI SRDNSKNTLY LQMNSLRAED TAVYYCARVA RGIAARSRTS YFDYWGQGTL   120
VTVSSASTKG PSVFPLAPSS KS                                            142

M206-H05 LC (SEQ ID NO: 1677)
QDIQMTQSPG TLSLSPGERA TLSCRTSQFV NSNYLAWYQQ TPGQAPRLLI YGASSRATGI    60
PDRFSGTGYG TDFTLTISRL EPEDYGTYYC QQSSRTPWTF GQGTRVEIK               109

M206-H05 HC (SEQ ID NO: 1678)
EVQLLESGGG LVQPGGSLRL SCAASGFTFS GYKMqWVRQA PGKGLEWVSS ISPSGGITMY    60
ADSVKGRFTI SRDNSKNTLY LQMNSLRAED TAVYYCARVA RGIAARSRTS YFDYWGQGTL   120
VTVSSASTKG PSVFPLAPSS KS                                            142

M206-H08 LC (SEQ ID NO: 1679)
QDIQMTQSPG TLSLSPGERA TLSCRTSQFV NSNYLAWYQQ TPGQAPRLLI YGASSRATGI    60
PDRFSGTGYG TDFTLTISRL EPEDYGTYYC QQSSRTPWTF GQGTRVEIK               109

M206-H08 HC (SEQ ID NO: 1680)
EVQLLESGGG LVQPGGSLRL SCAASGFTFS DYMMAWVRQA PGKGLEWVSS IVPSGGHTHY    60
ADSVKGRFTI SRDNSKNTLY LQMNSLRAED TAVYYCARVA RGIAARSRTS YFDYWGQGTL   120
VTVSSASTKG PSVFPLAPSS KS                                            142

M207-A01 LC (SEQ ID NO: 1681)
QDIQMTQSPG TLSLSPGERA TLSCRTSQFV NSNYLAWYQQ TPGQAPRLLI YGASSRATGI    60
PDRFSGTGYG TDFTLTISRL EPEDYGTYYC QQSSRTPWTF GQGTRVEIK               109

M207-A01 HC (SEQ ID NO: 1682)
EVQLLESGGG LVQPGGSLRL SCAASGFTFS HYLMTWVRQA PGKGLEWVSY ISPSGGHTIY    60
ADSVKGRFTI SRDNSKNTLY LQMNSLRAED TAVYYCARVA RGISARSRTS CFDYWGQGTL   120
VTVSSASTKG PSVFPLAPSS KS                                            142

M207-A02 LC (SEQ ID NO: 1683)
QDIQMTQSPG TLSLSPGERA TLSCRTSQFV NSNYLAWYQQ TPGQAPRLLI YGASSRATGI    60
PDRFSGTGYG TDFTLTISRL EPEDYGTYYC QQSSRTPWTF GQGTRVEIK               109

M207-A02 HC (SEQ ID NO: 1684)
EVQLLESGGG LVQPGGSLRL SCAASGFTFS HYLMTWVRQA PGKGLEWVSY ISPSGGHTIY    60
ADSVKGRFTI SRDNSKNTLY LQMNSLRAED TALYYCARVA RGIAARSRTI NLDYWGQGTL   120
VTVSSASTKG PSVFPLAPSS KS                                            142

M207-A04 LC (SEQ ID NO: 1685)
QDIQMTQSPG TLSLSPGERA TLSCRTSQFV NSNYLAWYQQ TPGQAPRLLI YGASSRATGI    60
PDRFSGTGYG TDFTLTISRL EPEDYGTYYC QQSSRTPWTF GQGTRVEIK               109

M207-A04 HC (SEQ ID NO: 1686)
EVQLLESGGG LVQPGGSLRL SCAASGFTFS HYLMTWVRQA PGKGLEWVSY ISPSGGHTIY    60
ADSVKGRFTI SRDNSKNTLY LQMNSLRAED TAVYYCARVA RGIAARSRTS YFDYWGQGTL   120
VTVSSASTKG PSVFPLAPSS KS                                            142

M207-C05 LC (SEQ ID NO: 1687)
QDIQMTQSPG TLSLSPGERA TLSCRTSQFV NSNYLAWYQQ TPGQAPRLLI YGASSRATGI    60
PDRFSGTGYG TDFTLTISRL EPEDYGTYYC QQSSRTPWTF GQGTRVEIK               109

R0121-D02 = M0207-C05 HC (SEQ ID NO: 1688)
EVQLLESGGG LVQPGGSLRL SCAASGFTFS HYLMTWVRQA PGKGLEWVSY ISPSGGHTIY    60
ADSVKGRFTI SRDNSKNTLY LQMNSLRAED TAVYYCARVG RGIAARSRTS YFDKWGQGTL   120
VTVSSASTKG PSVFPLAPSS KS                                            142

M208-A10 LC (SEQ ID NO: 1689)
QDIQMTQSPG TLSLSPGERA TLSCRTSQFV NSNYLAWYQQ TPGQAPRLLI YGASSRATGI    60
PDRFSGTGYG TDFTLTISRL EPEDYGTYYC QQSSRTPWTF GQGTRVEIK               109

M208-A10 HC (SEQ ID NO: 1690)
EVQLLESGGG LVQPGGSLRL SCAASGFTFS HYLMTWVRQA PGKGLEWVSY ISPSGGHTIY    60
ADSVKGRFTI SRDNSKNTLY LQMNSLRAED TAVYYCARVA RGIAARSRTS qFDHWGQGTL   120
VTVSSASTKG PSVFPLAPSS KS                                            142

M208-B01 LC (SEQ ID NO: 1691)
QDIQMTQSPG TLSLSPGERA TLSCRTSQFV NSNYLAWYQQ TPGQAPRLLI YGASSRATGI    60
PDRFSGTGYG TDFTLTISRL EPEDYGTYYC QQSSRTPWTF GQGTRVEIK               109

M208-B01 HC (SEQ ID NO: 1692)
EVQLLESGGG LVQPGGSLRL SCAASGFTFS HYLMTWVRQA PGKGLEWVSY ISPSGGHTIY    60
ADSVKGRFTI SRDNSKNTLY LQMNSLRAED TAVYYCARVA RGIAARSRTS FFDqWGQGTL   120
VTVSSASTKG PSVFPLAPSS KS                                            142
```

```
M208-C06 LC (SEQ ID NO: 1693)
QDIQMTQSPG TLSLSPGERA TLSCRTSQFV NSNYLAWYQQ TPGQAPRLLI YGASSRATGI   60
PDRFSGTGYG TDFTLTISRL EPEDYGTYYC QQSSRTPWTF GQGTRVEIK              109

M208-C06 HC (SEQ ID NO: 1694)
EVQLLESGGG LVQPGGSLRL SCAASGFTFS HYLMTWVRQA PGKGLEWVSY ISPSGGHTIY   60
ADSVKGRFTI SRDNSKNTLY LQMNSLRAED TAVYYCARVA RGIAARSRTS FIDYWGQGTL  120
VTVSSASTKG PSVFPLAPSS KS                                           142

M208-D12 LC (SEQ ID NO: 1695)
QDIQMTQSPG TLSLSPGERA TLSCRTSQFV NSNYLAWYQQ TPGQAPRLLI YGASSRATGI   60
PDRFSGTGYG TDFTLTISRL EPEDYGTYYC QQSSRTPWTF GQGTRVEIK              109

M208-D12 HC (SEQ ID NO: 1696)
EVQLLESGGG LVQPGGSLRL SCAASGFTFS HYLMTWVRQA PGKGLEWVSY ISPSGGHTIY   60
ADSVKGRFTI SRDNSKNTLY LQMNSLRAED TAVYYCARLA RGIAARSRTS YqDIWGQGTL  120
VTVSSASTKG PSVFPLAPSS KS                                           142

M208-E10 LC (SEQ ID NO: 1697)
QDIQMTQSPG TLSLSPGERA TLSCRTSQFV NSNYLAWYQQ TPGQAPRLLI YGASSRATGI   60
PDRFSGTGYG TDFTLTISRL EPEDYGTYYC QQSSRTPWTF GQGTRVEIK              109

M208-E10 HC (SEQ ID NO: 1698)
EVQLLESGGG LVQPGGSLRL SCAASGFTFS HYLMTWVRQA PGKGLEWVSY ISPSGGHTIY   60
ADSVKGRFTI SRDNSKNTLY LQMNSLRAED TAVYYCARVA QGISARSRTS YFDYWGQGTL  120
VTVSSASTKG PSVFPLAPSS KS                                           142

M208-F04 LC (SEQ ID NO: 1699)
QDIQMTQSPG TLSLSPGERA TLSCRTSQFV NSNYLAWYQQ TPGQAPRLLI YGASSRATGI   60
PDRFSGTGYG TDFTLTISRL EPEDYGTYYC QQSSRTPWTF GQGTRVEIK              109

M208-F04 HC (SEQ ID NO: 1700)
EVQLLESGGG LVQPGGSLRL SCAASGFTFS HYLMTWVRQA PGKGLEWVSY ISPSGGHTIY   60
ADSVKGRFTI SRDNSKNTLY LQMNSLRAED TAVYYCARVA RGIAARSRTS FFDYWGQGTL  120
VTVSSASTKG PSVFPLAPSS KS                                           142

M208-F10 LC (SEQ ID NO: 1701)
QDIQMTQSPG TLSLSPGERA TLSCRTSQFV NSNYLAWYQQ TPGQAPRLLI YGASSRATGI   60
PDRFSGTGYG TDFTLTISRL EPEDYGTYYC QQSSRTPWTF GQGTRVEIK              109

M208-F10 HC (SEQ ID NO: 1702)
EVQLLESGGG LVQPGGSLRL SCAASGFTFS HYLMTWVRQA PGKGLEWVSY ISPSGGHTIY   60
ADSVKGRFTI SRDNSKNTLY LQMNSLRAED TAVYYCARVA RGIAARSRTS YFDqWGQGTL  120
VTVSSASTKG PSVFPLAPSS KS                                           142

M208-G02 LC (SEQ ID NO: 1703)
QDIQMTQSPG TLSLSPGERA TLSCRTSQFV NSNYLAWYQQ TPGQAPRLLI YGASSRATGI   60
PDRFSGTGYG TDFTLTISRL EPEDYGTYYC QQSSRTPWTF GQGTRVEIK              109

M208-G02 HC (SEQ ID NO: 1704)
EVQLLESGGG LVQPGGSLRL SCAASGFTFS HYLMTWVRQA PGKGLEWVSY ISPSGGHTIY   60
ADSVKGRFTI SRDNSKNTLY LQMNSLRAED TAVYYCARVA RGIADRSRTS YSDYWGQGTL  120
VTVSSASTKG PSVFPLAPSS KS                                           142

M208-G03 LC (SEQ ID NO: 1705)
QDIQMTQSPG TLSLSPGERA TLSCRTSQFV NSNYLAWYQQ TPGQAPRLLI YGASSRATGI   60
PDRFSGTGYG TDFTLTISRL EPEDYGTYYC QQSSRTPWTF GQGTRVEIK              109

M208-G03 HC (SEQ ID NO: 1706)
EVQLLESGGG LVQPGGSLRL SCAASGFTFS HYLMTWVRQA PGKGLEWVSY ISPSGGHTIY   60
ADSVKGRFTI SRDNSKNTLY LQMNSLRAED TAVYYCARVA RGIAARSRTS YLDYWGQGTL  120
VTVSSASTKG PSVFPLAPSS KS                                           142

M208-H02 LC (SEQ ID NO: 1707)
QDIQMTQSPG TLSLSPGERA TLSCRTSQFV NSNYLAWYQQ TPGQAPRLLI YGASSRATGI   60
PDRFSGTGYG TDFTLTISRL EPEDYGTYYC QQSSRTPWTF GQGTRVEIK              109

M208-H02 HC (SEQ ID NO: 1708)
EVQLLESGGG LVQPGGSLRL SCAASGFTFS HYLMTWVRQA PGKGLEWVSY ISPSGGHTIY   60
ADSVKGRFTI SRDNSKNTLY LQMNSLRAED TAVYYCARVA RGIASRSRTR YCDYWGQGTL  120
VTVSSASTKG PSVFPLAPSS KS                                           142

M209-B01 LC (SEQ ID NO: 1709)
QDIQMTQSPG TLSLSPGERA TLSCRTSQFV NSNYLAWYQQ TPGQAPRLLI YGASSRATGI   60
PDRFSGTGYG TDFTLTISRL EPEDYGTYYC QQSSRTPWTF GQGTRVEIK              109

M209-B01 HC (SEQ ID NO: 1710)
EVQLLESGGG LVQPGGSLRL SCAASGFTFS HYLMTWVRQA PGKGLEWVSY ISPSGGHTIY   60
ADSVKGRFTI SRDNSKNTLY LQMNSLRAED TAVYYCARVA RGIVARSRTS NFDqWGQGTL  120
VTVSSASTKG PSVFPLAPSS KS                                           142
```

```
M209-B09 LC (SEQ ID NO: 1711)
QDIQMTQSPG TLSLSPGERA TLSCRTSQFV NSNYLAWYQQ TPGQAPRLLI YGASSRATGI   60
PDRFSGTGYG TDFTLTISRL EPEDYGTYYC QQSSRTPWTF GQGTRVEIK              109

M209-B09 HC (SEQ ID NO: 1712)
EVQLLESGGG LVQPGGSLRL SCAASGFTFS HYLMTWVRQA PGKGLEWVSY ISPSGGHTIY   60
ADSVKGRFTI SRDNSKNTLY LQMNSLRAED TAVYYCARVA QGIVARSRTS YLHqWGQGTL  120
VTVSSASTKG PSVFPLAPSS KS                                           142

M209-B11 LC (SEQ ID NO: 1713)
QDIQMTQSPG TLSLSPGERA TLSCRTSQFV NSNYLAWYQQ TPGQAPRLLI YGASSRATGI   60
PDRFSGTGYG TDFTLTISRL EPEDYGTYYC QQSSRTPWTF GQGTRVEIK              109

M209-B11 HC (SEQ ID NO: 1714)
EVQLLESGGG LVQPGGSLRL SCAASGFTFS HYLMTWVRQA PGKGLEWVSY ISPSGGHTIY   60
ADSVKGRFTI SRDNSKNTLY LQMNSLRAED TAVYYCARVA RGIAARSRTS YIDqWGQGTL  120
VTVSSASTKG PSVFPLAPSS KS                                           142

M209-C02 LC (SEQ ID NO: 1715)
QDIQMTQSPG TLSLSPGERA TLSCRTSQFV NSNYLAWYQQ TPGQAPRLLI YGASSRATGI   60
PDRFSGTGYG TDFTLTISRL EPEDYGTYYC QQSSRTPWTF GQGTRVEIK              109

M209-C02 HC (SEQ ID NO: 1716)
EVQLLESGGG LVQPGGSLRL SCAASGFTFS HYLMTWVRQA PGKGLEWVSY ISPSGGHTIY   60
ADSVKGRFTI SRDNSKNTLY LQMNSLRAED TAVYYCARVA RGIAYRRRTS YFDYWGQGTL  120
VTVSSASTKG PSVFPLAPSS KS                                           142

M209-C11 LC (SEQ ID NO: 1717)
QDIQMTQSPG TLSLSPGERA TLSCRTSQFV NSNYLAWYQQ TPGQAPRLLI YGASSRATGI   60
PDRFSGTGYG TDFTLTISRL EPEDYGTYYC QQSSRTPWTF GQGTRVEIK              109

M209-C11 HC (SEQ ID NO: 1718)
EVQLLESGGG LVQPGGSLRL SCAASGFTFS HYLMTWVRQA PGKGLEWVSY ISPSGGHTIY   60
ADSVKGRFTI SRDNSKNTLY LQMNSLRAED TAVYYCAMVG QGIRGRSRTS YFAqWGQGTL  120
VTVSSASTKG PSVFPLAPSS KS                                           142

M209-C12 LC (SEQ ID NO: 1719)
QDIQMTQSPG TLSLSPGERA TLSCRTSQFV NSNYLAWYQQ TPGQAPRLLI YGASSRATGI   60
PDRFSGTGYG TDFTLTISRL EPEDYGTYYC QQSSRTPWTF GQGTRVEIK              109

M209-C12 HC (SEQ ID NO: 1720)
EVQLLESGGG LVQPGGSLRL SCAASGFTFS HYLMTWVRQA PGKGLEWVSY ISPSGGHTIY   60
ADSVKGRFTI SRDNSKNTLY LQMNSLRAED TAVYYCARVG RGIAARSRTS qLDYWGQGTL  120
VTVSSASTKG PSVFPLAPSS KS                                           142

M209-D02 LC (SEQ ID NO: 1721)
QDIQMTQSPG TLSLSPGERA TLSCRTSQFV NSNYLAWYQQ TPSQAPRLLI YGASSRATGI   60
PDRFSGTGYG TDFTLTISRL EPEDYGTYYC QQSSRTPWTF GQGTRVEIK              109

M209-D02 HC (SEQ ID NO: 1722)
EVQLLESGGG LVQPGGSLRL SCAASGFTFS HYLMTWVRQA PGKGLEWVSY ISPSGGHTIY   60
ADSVKGRFTI SRDNSKNTLY LQMNSLRAED TAVYYCARVA RGITARSRTS YFDDWGQGTL  120
VTVSSASTKG PSVFPLAPSS KS                                           142

M209-D03 LC (SEQ ID NO: 1723)
QDIQMTQSPG TLSLSPGERA TLSCRTSQFV NSNYLAWYQQ TPGQAPRLLI YGASSRATGI   60
PDRFSGTGYG TDFTLTISRL EPEDYGTYYC QQSSRTPWTF GQGTRVEIK              109

M209-D03 HC (SEQ ID NO: 1724)
EVQLLESGGG LVQPGGSLRL SCAASGFTFS HYLMTWVRQA PGKGLEWVSY ISPSGGHTIY   60
ADSVKGRFTI SRDNSKNTLY LQMNSLRAED TAVYYCARVG RGIAARSRTS FFDqWGQGTL  120
VTVSSASTKG PSVFPLAPSS KS                                           142

M209-D12 LC (SEQ ID NO: 1725)
QDIQMTQSPG TLSLSPGERA TLSCRTSQFV NSNYLAWYQQ TPGQAPRLLI YGASSRATGI   60
PDRFSGTGYG TDFTLTISRL EPEDYGTYYC QQSSRTPWTF GQGTRVEIK              109

M209-D12 HC (SEQ ID NO: 1726)
EVQLLESGGG LVQPGGSLRL SCAASGFTFS HYLMTWVRQA PSKGLEWVSY ISPSGGHTIY   60
ADSVKGRFTI SRDNSKNTLY LQMNSLRAED TAVYYCATVA RGIAARSRTS YFDqWGQGTL  120
VTVSSASTKG PSVFPLAPSS KS                                           142

M209-E02 LC (SEQ ID NO: 1727)
QDIQMTQSPG TLSLSPGERA TLSCRTSQFV NSNYLAWYQQ TPGQAPRLLI YGASSRATGI   60
PDRFSGTGYG TDFTLTISRL EPEDYGTYYC QQSSRTPWTF GQGTRVEIK              109

M209-E02 HC (SEQ ID NO: 1728)
EVQLLESGGG LVQPGGSLRL SCAASGFTFS HYLMTWVRQA PGKGLEWVSY ISPSGGHTIY   60
ADSVKGRFTI SRDNSKNTLY LQMNSLRAED TAVYYCARVA RGIAARSRTI LLDqWGQGTL  120
VTVSSASTKG PSVFPLAPSS KS                                           142
```

```
M209-E03 LC (SEQ ID NO: 1729)
QDIQMTQSPG TLSLSPGERA TLSCRTSQFV NSNYLAWYQQ TPGQAPRLLI YGASSRATGI    60
PDRFSGTGYG TDFTLTISRL EPEDYGTYYC QQSSRTPWTF GQGTRVEIK               109

M209-E03 HC (SEQ ID NO: 1730)
EVQLLESGGG LVQPGGSLRL SCAASGFTFS HYLMTWVRQA PGKGLEWVSY ISPSGGHTIY    60
ADSVKGRFTI SRDNSKNTLY LQMNSLRAED TAVYYCARqA RGIAARSRTS YFDYWGQGTL   120
VTVSSASTKG PSVFPLAPSS KS                                            142

M209-F04 LC (SEQ ID NO: 1731)
QDIQMTQSPG TLSLSPGERA TLSCRTSQFV NSNYLAWYQQ TPGQAPRLLI YGASSRATGI    60
PDRFSGTGYG TDFTLTISRL EPEDYGTYYC QQSSRTPWTF GQGTRVEIK               109

M209-F04 HC (SEQ ID NO: 1732)
EVQLLESGGG LVQPGGSLRL SCAASGFTFS HYLMTWVRQA PSKGLEWVSY ISPSGGHTIY    60
ADSVKGRFTI SRDNSKNTLY LQMNSLRAED TAVYYCARVA RGIAARSRTS YLDqWSQGTL   120
VTVSSASTKG PSVFPLAPSS KS                                            142

M209-G01 LC (SEQ ID NO: 1733)
QDIQMTQSPG TLSLSPGERA TLSCRTSQFV NSNYLAWYQQ TPGQAPRLLI YGASSRATGI    60
PDRFSGTGYG TDFTLTISRL EPEDYGTYYC QQSSRTPWTF GQGTRVEIK               109

M209-G01 HC (SEQ ID NO: 1734)
EVQLLESGGG LVQPGGSLRL SCAASGFTFS HYLMTWVRQA PGKGLEWVSY ISPSGGHTIY    60
ADSVKGRFTI SRDNSKNTLY LQMNSLRAED TAVYYCARVA qGISGRSRLS YVDYWGQGTL   120
VTVSSASTKG PSVFPLAPSS KS                                            142

M209-G07 LC (SEQ ID NO: 1735)
QDIQMTQSPG TLSLSPGERA TLSCRTSQFV NSNYLAWYQQ TPGQAPRLLI YGASSRATGI    60
PDRFSGTGYG TDFTLTISRL EPEDYGTYYC QQSSRTPWTF GQGTRVEIK               109

M209-G07 HC (SEQ ID NO: 1736)
EVQLLESGGG LVQPGGSLRL SCAASGFTFS HYLMTWVRQA PGKGLEWVSY ISPSGGHTIY    60
ADSVKGRFTI SRDNSKNTLY LQMNSLRAED TAVYYCARVA RGIAARSRTS YFDTWGQGTL   120
VTVSSASTKG PSVFPLAPSS KS                                            142

M209-H03 LC (SEQ ID NO: 1737)
QDIQMTQSPG TLSLSPGERA TLSCRTSQFV NSNYLAWYQQ TPGQAPRLLI YGASSRATGI    60
PDRFSGTGYG TDFTLTISRL EPEDYGTYYC QQSSRTPWTF GQGTRVEIK               109

M209-H03 HC (SEQ ID NO: 1738)
EVQLLESGGG LVQPGGSLRL SCAASGFTFS HYLMTWVRQA PSKGLEWVSY ISPSGGHTIY    60
ADSVKGRFTI SRDNSKNTLY LQMNSLRAED TAVYYCARVA QGIAARSRTT qFDYWGQGTL   120
VTVSSASTKG PSVFPLAPSS KS                                            142

M209-H07 LC (SEQ ID NO: 1739)
QDIQMTQSPG TLSLSPGERA TLSCRTSQFV NSNYLAWYQQ TPGQAPRLLI YGADDRATGI    60
PDRFSGTGYG TDFTLTISRL EPEDYGTYYC QQSSRTPWTF GQGTRVEIK               109

M209-H07 HC (SEQ ID NO: 1740)
EVQLLESGGG LVQPGGSLRL SCAASGFTFS HYLMTWVRQA PGKGLEWVSY ISPSGGHTIY    60
ADSVKGRFTI SRDNSKNTLY LQMNSLRAED TAVYYCARVA RGIAARqRTS YYDYWGQGTL   120
VTVSSASTKG PSVFPLAPSS KS                                            142

M209-H09 LC (SEQ ID NO: 1741)
QDIQMTQSPG TLSLSPGERA TLSCRTSQFV NSNYLAWYQQ TPGQAPRLLI YGASSRATGI    60
PDRFSGTGYG TDFTLTISRL EPEDYGTYYC QQSSRTPWTF GQGTRVEIK               109

M209-H09 HC (SEQ ID NO: 1742)
EVQLLESGGG LVQPGGSLRL SCAASGFTFS HYLMTWVRQA PGKGLEWVSY ISPSGGHTIY    60
ADSVKGRFTI SRDNSKNTLY LQMNSLRAED TAVYYCARVA RGIAARSRTV YFDHWGQGTL   120
VTVSSASTKG PSVFPLAPSS KS                                            142

M210-A06 LC (SEQ ID NO: 1743)
QDIQMTQSPG TLSLSPGERA TLSCRTSQFV NSNYLAWYQQ TPGQAPRLLI YGASSRATGI    60
PDRFSGTGYG TDFTLTISRL EPEDYGTYYC QQSSRTPWTF GQGTRVEIK               109

M210-A06 HC (SEQ ID NO: 1744)
EVQLLESGGG LVQPGGSLRL SCAASGFTFS HYLMTWVRQA PGKGLEWVSY ISPSGGHTIY    60
ADSVKGRFTI SRDNSKNTLY LQMNSLRAED TAVYYCARVA RGIAARSRTS qFDYWGQGTL   120
VTVSSASTKG PSVFPLAPSS KS                                            142

M210-B02 LC (SEQ ID NO: 1745)
QDIQMTQSPG TLSLSPGERA TLSCRTSQFV NSNYLAWYQQ TPGQAPRLLI YGASSRATGI    60
PDRFSGTGYG TDFTLTISRL EPEDYGTYYC QQSSRTPWTF GQGTRVEIK               109

M210-B02 HC (SEQ ID NO: 1746)
EVQLLESGGG LVQPGGSLRL SCAASGFTFS HYLMTWVRQA PGKGLEWVSY ISPSGGHTIY    60
ADSVKGRFTI SRDNSKNTLY LQMNSLRAED TAVYYCASVA RGIAARSRTS YFNqWGQGTL   120
VTVSSASTKG PSVFPLAPSS KS                                            142
```

```
M210-C12 LC (SEQ ID NO: 1747)
QDIQMTQSPG TLSLSPGERA TLSCRTSQFV NSNYLAWYQQ TPGQAPRLLI YGASSRATGI    60
PDRFSGTGYG TDFTLTISRL EPEDYGTYYC QQSSRTPWTF GQGTRVEIK               109

M210-C12 HC (SEQ ID NO: 1748)
EVQLLESGGG LVQPGGSLRL SCAASGFTFS HYLMTWVRQA PGKSLEWVSY ISPSGGHTIY    60
ADSVKGRFTI SRDNSKNTLY LQMNSLRAED TAVYYCARVA QGIAARSRTS SVDqWGQGTL   120
VTVSSASTKG PSVFPLAPSS KS                                            142

M210-G04 LC (SEQ ID NO: 1749)
QDIQMTQSPG TLSLSPGERA TLSCRTSQFV NSNYLAWYQQ TPGQAPRLLI YGASSRATGI    60
PDRFSGTGYG TDFTLTISRL EPEDYGTYYC QQSSRTPWTF GQGTRVEIK               109

M210-G04 HC (SEQ ID NO: 1750)
EVQLLESGGG LVQPGGSLRL SCAASGFTFS HYLMTWVRQA PGKGLEWVSY ISPSGGHTIY    60
ADSVKGRFTI SRDNSKNTLY LQMNSLRAED TAVYYCARVA TGIVARSRTR YFDqWGQGTL   120
VTVSSASTKG PSVFPLAPSS KS                                            142

M210-G10 LC (SEQ ID NO: 1751)
QDIQMTQSPG TLSLSPGERA TLSCRTSQFV NSNYLAWYQQ TPGQAPRLLI YGASSRATGI    60
PDRFSGTGYG TDFTLTISRL EPEDYGTYYC QQSSRTPWTF GQGTRVEIK               109

M210-G10 HC (SEQ ID NO: 1752)
EVQLLESGGG LVQPGGSLRL SCAASGFTFS HYLMTWVRQA PGKGLEWVSY ISPSGGHTIY    60
ADSVKGRFTI SRDNSKNTLY LQMNSLRAED TAVYYCARVA RGIAARSRTS YLDFWGQGTL   120
VTVSSASTKG PSVFPLAPSS KS                                            142

M210-H01 LC (SEQ ID NO: 1753)
QDIQMTQSPG TLSLSPGERA TLSCRTSQFV NSNYLAWYQQ TPGQAPRLLI YGASSRATGI    60
PDRFSGTGYG TDFTLTISRL EPEDYGTYYC QQSSRTPWTF GQGTRVEIK               109

M210-H01 HC (SEQ ID NO: 1754)
EVQLLESGGG LVQPGGSLRL SCAASGFTFS HYLMTWVRQA PGKGLEWVSY ISPSGGHTIY    60
ADSVKGRFTI SRDNSKNTLY LQMNSLRAED TAVYYCARVA RGIAARSRNS qQDYWGQGTL   120
VTVSSASTKG PSVFPLAPSS KS                                            142

M210-H06 LC (SEQ ID NO: 1755)
QDIQMTQSPG TLSLSPGERA TLSCRTSQFV NSNYLAWYQQ TPGQAPRLLI YGASSRATGI    60
PDRFSGTGYG TDFTLTISRL EPEDYGTYYC QQSSRTPWTF GQGTRVEIK               109

M210-H06 HC (SEQ ID NO: 1756)
EVQLLESGGG LVQPGGSLRL SCAASGFTFS HYLMTWVRQA PGKGLEWVSY ISPSGGHTIY    60
ADSVKGRFTI SRDNSKNTLY LQMNSLRAED TAVYYCARVA RGIAARSRTR YFDYWGQGTL   120
VTVSSASTKG PSVFPLAPSS KS                                            142

M210-H07 LC (SEQ ID NO: 1757)
QDIQMTQSPG TLSLSPGERA TLSCRTSQFV NSNYLAWYQQ TPGQAPRLLI YGASSRATGI    60
PDRFSGTGYG TDFTLTISRL EPEDYGTYYC QQSSRTPWTF GQGTRVEIK               109

M210-H07 HC (SEQ ID NO: 1758)
EVQLLESGGG LVQPGGSLRL SCAASGFTFS HYLMTWVRQA PGKGLEWVSY ISPSGGHTIY    60
ADSVKGRFTI SRDNSKNTLY LQMNSLRAED TAVYYCARVA RGIAARSRTR YFDqWGQGTL   120
VTVSSASTKG PSVFPLAPSS KS                                            142
```

Example 8

Evaluation of Selected Antibody Inhibitors of Plasma Kallikrein

Evaluation of selected optimized antibodies (X81-B01 and X67-D03) is shown in Table 14. Neither antibody has any putative deamidation, isomerization, or oxidation sites.

TABLE 14

| Criteria | X81-B01 (IgG) | X67-D03 (IgG) |
|---|---|---|
| < nM Ki, app against human pKal | 0.2 nM | 0.1 nM |
| < nM Ki, app against rodent pKal | mouse - 11 pM | mouse - 0.7 nM |
|  | rat - 0.14 nM | rat - 0.34 nM |
| Does not bind prekallikrein | no | no |
| Specific inhibitor with respect to fXIa, plasmin, and trypsin | yes | yes |
| Inhibits bradykinin generation | yes | yes |
| Inhibits pKal in presence of prekallikrein | yes | yes |
| Competition for binding with aprotinin | yes | yes |
| Stability in human serum | nd | nd* |

*not done; parental forms of both antibodies were shown to be stable in serum

Example 9

Epitope Mapping

The region of pKal bound by selected anti-pKal antibodies was investigated using several methods. First, competition assays were used to determine whether the antibodies competed for binding to pKal with known active site-directed inhibitors. Second, antibodies were grouped according to whether they were inhibitors or just binders to pKal. Third, epitopes were investigated using synthetic peptides and peptidic structures based on the sequence and 3-dimensional structure of pKal. These peptidic structures are called "CLIPS" (Chemically Linked Peptides on Scaffolds) and the testing was performed by a fee for service company called Pepscan.

Fourth, antibodies were tested for their ability to inhibit pKal from other species, besides human, where the amino acid sequence of pKal has been determined in order to identify amino acids that may account for the differences in inhibition.

either bind in vicinity of the active site or allosteric changes in the conformation of the pKal-EPI-KAL2 complex prevent antibody binding.

Antibody Binders Vs Inhibitors

Antibodies that inhibit the activity of pKal either bind near the active site and preclude substrate interactions (competitive inhibitors) or that bind away from the active site and induce allosteric changes in the structure of the active site (noncompetitive inhibitors). As shown in Table 15, for the listed antibodies, is a demonstration of whether they cross-react with mouse pKal as inhibitors and whether they bind prekallikrein.

TABLE 15

Binding Properties of Selected Anti-pKal Antibodies

| Number | Antibody | Binding Category | human Ki, app (nM) | mouse Ki, app (nM) | CLIPS Peptide(s) Identified |
|---|---|---|---|---|---|
| 2 | M6-D09 | 2) inhibitor, prekallikrein binder, inhibits mouse and human pKal | 5.9 | 3.9 | C1, C5 |
| 5 | M29-D09 | 3) inhibitor, does not bind prekallikrein, does not inhibit mouse pKal | 0.7 | no | C1, C4, C7 |
| 6 | M35-G04 | 2) inhibitor, prekallikrein binder, inhibits mouse and human pKal | 2.9 | 8 | C1, C4 |
| 7 | M145-D11 | 3) inhibitor, does not bind prekallikrein, weak inhibitor of mouse pKal | 0.79 | 800 | C1, C4 |
| 8 | M160-G12 | 4) inhibitor of both mouse and human pKal, does not bind prekallikrein | 5 | 0.2 | C2 |
| 9 | X55-F01 | 4) inhibitor of both mouse and human pKal, does not bind prekallikein | 0.4 | 2 | C2, C3 |
| 10 | X73-H09 | 4) inhibitor, does not bind prekallikrein, weak inhibitor of human and mouse pKal | 20 | 70 | C6 |
| 11 | X81-B01 | 4) inhibitor of both mouse and human pKal, does not bind prekallikein | 0.1 | 0.011 | C2, C3, C5, C6 |
| 12 | A2 | 5) Negative control, does not bind pKal, binds streptavidin | No binding | No binding | No binding |

C1-C7: peptides in pKal identified by CLIPS epitope mapping (see FIGS. 8 and 9A-9C). C1 corresponds to positions 55-67 of the catalytic domain, C2 to positions 81-94, C3 to positions 101-108, C4 to positions 137-151, C5 to positions 162-178, C6 to positions 186-197, and C7 to positions 214-217.

Competition Assays

Using a BIACORE® SPR assay antibodies of interest were tested for competion with a known active site inhibitor of pKal. EPI-KAL2 is potent ($K_{i,app}$=0.1 nM) active site inhibitor of pKal and a Kunitz domain inhibitor based on the first domain of tissue factor pathway inhibitor (Markland (1996) *Iterative optimization of high-affinity protease inhibitors using phage display*. 2. Plasma kallikrein and thrombin, Biochemistry 35 (24):8058-67). Kunitz domains are known active site inhibitors of serine proteases, such as pKal.

The sequence of EPI-KAL2 is:

EAMHSFCAFKA*DDGP*C*RAA*H*PRW*FFNIFTRQC*EEFS*YGGC*GGNQ*NRFESL

EECKKMCTRD (SEQ ID NO: 1759)

(amino acids in italics are those that differ from TFPI)

Figure 7B:
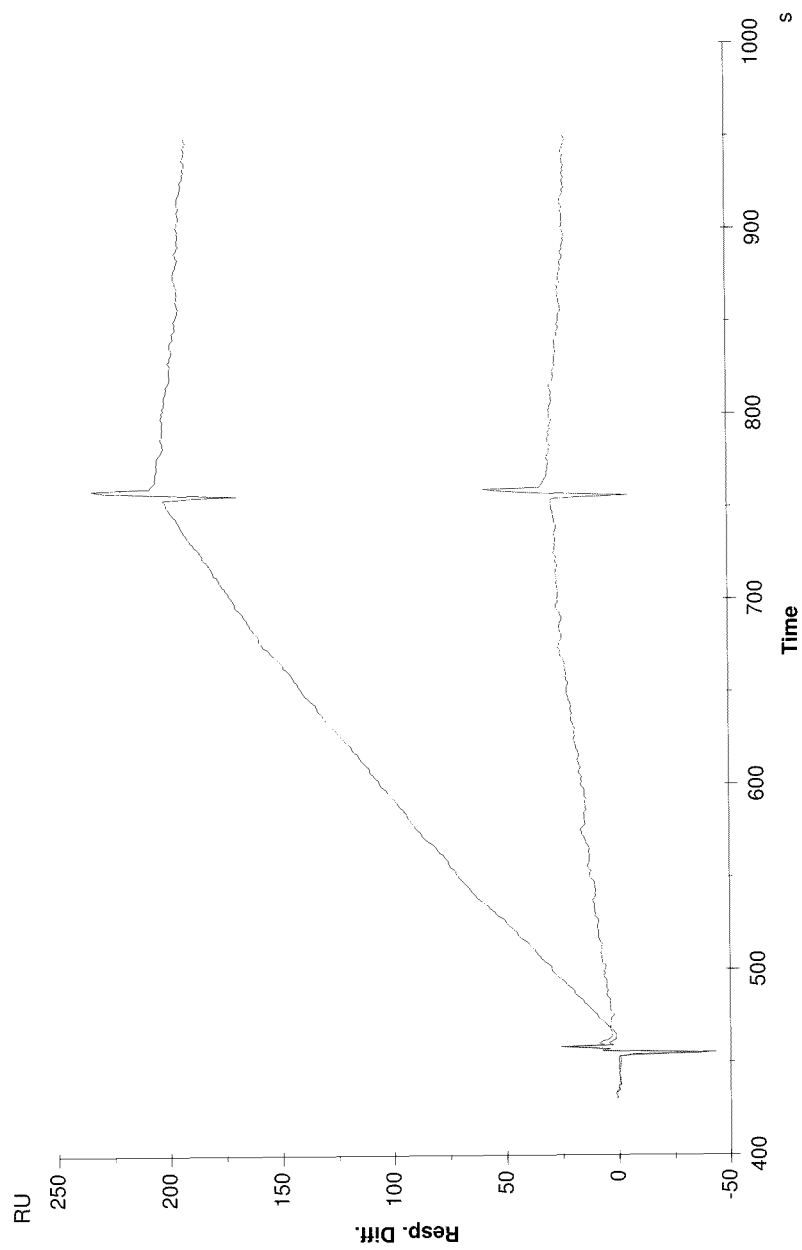
FIG. 7B depicts the EPI-KAL2 competition for X67-D03 binding pKal. X67-D03 (IgG) was captured on an anti-human Fc fragment specific surface of a CM5 Biacore chip. pKal (100 nM) was flowed over the surface in the presence (lower sensorgram in the figure) or absence of 1 μM EPI-KAL2 (upper sensorgram in the figure).

As shown in FIGS. 7A-7B, the antibodies X81-B01 and X67-D03 were competed for binding to pKal in the presence or EPI-KAL2. This result indicates that these antibodies Epitope Mapping Using CLIPS The anti-pKal antibodies listed in Table 15, plus one negative control (A2) and three antibodies that bound but did not inhibit pKal, were tested for binding to 5000 different synthetic CLIPS (Chemically Linked Peptides on Scaffolds) by Pepscan as described below in the CLIP METHODS sections. This analysis led to the identification of peptide regions in pKal that are likely to be a part of the antibody epitope for each of the tested antibodies (FIG. 8).

Clips Methods

The linear and CLIPS peptides were synthesized based on the amino acid sequence of the target protein using standard Fmoc-chemistry and deprotected using trifluoric acid with scavengers. The constrained peptides were synthesized on chemical scaffolds in order to reconstruct conformational epitopes, using Chemically Linked Peptides on Scaffolds (CLIPS) technology (Timmerman et al. (2007). For example, the single looped peptides were synthesized containing a dicysteine, which was cyclized by treating with alpha, alpha'- dibromoxylene and the size of the loop was varied by introducing cysteine residues at variable spacing. If other cysteines besides the newly introduced cysteines were present, they were replaced by alanine. The side-chains of the multiple cysteines in the peptides were coupled to CLIPS templates by reacting onto credit-card format polypropylene PEPSCAN cards (455 peptide formats/card) with a 0.5 mM solution of CLIPS template such as 1,3-bis(bromomethyl)benzene in ammonium bicarbonate (20 mM, pH 7.9)/acetonitrile (1:1(v/v)). The cards were gently shaken in the solution for 30 to 60 minutes while completely covered in solution. Finally, the cards were washed extensively with excess of $H_2O$ and sonicated in distrupt-buffer containing 1 percent SDS/0.1 percent beta-mercaptoethanol in PBS (pH 7.2) at 70° C. for 30 minutes, followed by sonication in $H_2O$ for another 45 minutes. The binding of antibody to each peptide were tested in a PEPSCAN-based ELISA. The 455-well credit card format polypropylene cards containing the covalently linked peptides were incubated with primary antibody solution for example consisting of 1 micrograms/mL diluted in blocking solution called SQ (4% horse serum, 5% ovalbumin (w/v) in PBS/1% Tween or diluted in PBS eg, 20% SQ) overnight. After washing, the peptides were incubated with a 1/1000 dilution of rabbit anti-human antibody peroxidase or goat-anti-human FAB peroxidase for one hour at 25° C. After washing, the peroxidase substrate 2,2'-azino-di-3-ethylbenzthiazoline sulfonate (ABTS) and 2 microliters of 3 percent $H_2O_2$ were added. After one hour, the color development was measured. The color development was quantified with a charge coupled device (CCD)—camera and an image processing system (as firstly described in Slootstra et al., 1996).

Data Calculation

Raw Data: Optical Density (Arbitrary OD Units)

The raw data are optical values obtained by a CCD-camera. The values mostly range from 0 to 3000, a log scale similar to 1 to 3 of a standard 96-well plate elisa-reader. First the CCD-camera makes a picture of the card before peroxidase coloring and then again a picture after the peroxidase coloring. These two pictures are substracted from each other which results in the data which is called raw-data. This is copied into the Peplab™ database. Then the values are copied to excel and this file is labeled as raw-data file. One follow-up manipulation is allowed. Sometimes a well contains an air-bubble resulting in a false-positive value, the cards are manually inspected and any values caused by an air-bubble are scored as 0.

Normally assays are not done in replicate (only upon request client request). Replicate tests are usually very similar. In addition, the dataset of thousands of peptides contains many peptides that are similar, thus results are never based on recognition of one peptide but on families of similar peptides. If one or a few peptides do not bind, or exhibit lower binding, in a replicate experiment, a different epitope mapping is not normally attributed.

Timmerman et al. (2007). Functional reconstruction and synthetic mimicry of a conformational epitope using CLIPS™ technology. *J. Mol. Recognit.* 20:283-99

Slootstra et al. (1996). Structural aspects of antibody-antigen interaction revealed through small random peptide libraries, *Molecular Diversity*, 1, 87-96.

Example 10

Analysis of pKal Sequences from Different Species

All available sequence of pKal were obtained from public databases and aligned using ClustalW and regions were highlighted based on solvent accessibility, contact with an active site Kunitz inhibitor, and those peptides identified by CLIPS analysis (FIGS. 9A-9C). Citrated plasma from each of these species was obtained and activated using a commercially available prekallikrein activator (from Enzyme Research Laboratories) according to the instructions of the manufacturer. Kallikrein activity was then measured in each of the samples in the presence or absence of X81-B01.

It was found that X81-B01 inhibited pKal from all the species except for pig pKal. Since the CLIPS analysis identified four peptides of pKal that X81-B01 binds to-C2 (positions 81-94), C3 (positions 101-108), C5 (positions 162-178) and C6 (positions 186-197)—differences in the pig pKal sequence that correspond to these peptides were examined to identify potential amino acids changes that account for the lack of inhibition of pig pKal by X81-B01. Peptides C2 and C3 are close in the sequence and are both highly similar in sequence among the different species. However, there is a difference at position 479. All the species except pig, frog, and dog have a serine at position 479. The frog and dog pKal sequence has an alanine and a threonine at position 479, respectively; both of which are considered conservative substitutions for a serine. In contrast, the pig pKal sequence has a leucine at position 479, which is a considerably less conservative substitution for a serine. Peptide C5 in pig pKal is highly similar to the sequences from the other species. However, at position 563, only in the pig pKal is a histidine present (bold in FIG. 9C). This position in all the other species, except frog, is a tyrosine. In the frog pKal, which is inhibited by X81-B01, this position is a threonine. Peptide C6 in pig pKal is again highly similar to the other sequences. However, only in the pig pKal sequence is position 585 a glutamate (in bold in FIG. 9C). In all the other species this position is an aspartate. This analysis may indicate potentially critical residues in pKal that interact with X81-B01.

REFERENCES

The contents of all cited references including literature references, issued patents, published or non-published patent applications cited throughout this application as well as those listed below are hereby expressly incorporated by reference in their entireties. In case of conflict, the present application, including any definitions herein, will control.

1. Sonis S T, Tracey C, Shklar G, Jenson J, Florine D. 1990. An animal model for mucositis induced by cancer chemotherapy. Oral Surg Oral Med Oral Pathol. 69:437-43.

2. Sonis S T, Eilers J P, Epstein J B, LeVeque F G, Liggett W H Jr, Mulagha M T, Peterson D E, Rose A H, Schubert M M, Spijkervet F K, Wittes J P. 1999. Validation of a new scoring system for the assessment of clinical trial research of oral mucositis induced by radiation or chemotherapy. Mucositis Study Group. Cancer. 85:2103-13.

EQUIVALENTS

A number of embodiments of the invention have been described. Nevertheless, it will be understood that various modifications may be made without departing from the spirit and scope of the invention. Accordingly, other embodiments are within the scope of the following claims.

SEQUENCE LISTING (1784 sequences)

SEQ ID NO: 1 - protein, 58 aa, Artificial Sequence
  Description of Artificial Sequence: Synthetic polypeptide
  MOD_RES (1)..(4): Any amino acid
  MOD_RES (6)..(11): Any amino acid
  MOD_RES (13)..(13): Any amino acid
  MOD_RES (15)..(29): Any amino acid
  MOD_RES (31)..(32): Any amino acid
  MOD_RES (34)..(35): Any amino acid
  MOD_RES (39)..(50): Any amino acid
  MOD_RES (52)..(54): Any amino acid
  MOD_RES (56)..(58): Any amino acid
  See specification as filed for detailed description of substitutions and preferred embodiments
XXXXCXXXXXXGXCXXXXXXXXXXXXXXXCXXFXXGGCXXXXXXXXXXXXCXXXCXXX

SEQ ID NO: 2 - protein, 60 aa, Artificial Sequence
  Description of Artificial Sequence: Synthetic polypeptide
EAMHSFCAFKADDGPCRAAHPRWFFNIFTRQCEEFIYGGCEGNQNRFESLEECKKMCTRD

SEQ ID NO: 3 - DNA, 180 bp, Artificial Sequence
  Description of Artificial Sequence: Synthetic polynucleotide
  CDS (1)..(180)
gaggctatgcactctttctgtgctttcaaggctgacgacggtccgtgcagagctgctcacccaagatggttcttcaacatcttcacgcgtcaatgcgaggagttcatctacggtggttgtgagggtaaccaaaacagattcgagtctctagaggagtgtaagaagatgtgtactagagac

SEQ ID NO: 4 - protein, 58 aa, Artificial Sequence
  Description of Artificial Sequence: Synthetic polypeptide
MHSFCAFKADDGPCKANHLRFFFNIFTRQCEEFSYGGCGGNQNRFESLEECKKMCTRD

SEQ ID NO: 5 - protein, 58 aa, Artificial Sequence
  Description of Artificial Sequence: Synthetic polypeptide
MHSFCAFKADDGHCKANHQRFFFNIFTRQCEEFTYGGCGGNQNRFESLEECKKMCTRD

SEQ ID NO: 6 - protein, 58 aa, Artificial Sequence
  Description of Artificial Sequence: Synthetic polypeptide
MHSFCAFKADDGHCKANHQRFFFNIFTRQCEQFTYGGCAGNQNRFESLEECKKMCTRD

SEQ ID NO: 7 - protein, 58 aa, Artificial Sequence
  Description of Artificial Sequence: Synthetic polypeptide
MHSFCAFKADDGHCKASLPRFFFNIFTRQCEEFIYGGCGGNQNRFESLEECKKMCTRD

SEQ ID NO: 8 - protein, 58 aa, Artificial Sequence
  Description of Artificial Sequence: Synthetic polypeptide
MHSFCAFKADDGHCKANHQRFFFNIFTRQCEEFSYGGCGGNQNRFESLEECKKMCTRD

SEQ ID NO: 9 - protein, 58 aa, Artificial Sequence
  Description of Artificial Sequence: Synthetic polypeptide
MHSFCAFKADDGHCKGAHLRFFFNIFTRQCEEFIYGGCEGNQNRFESLEECKKMCTRD

SEQ ID NO: 10 - protein, 58 aa, Artificial Sequence
  Description of Artificial Sequence: Synthetic polypeptide
MHSFCAFKADDGRCKGAHLRFFFNIFTRQCEEFIYGGCEGNQNRFESLEECKKMCTRD

SEQ ID NO: 11 - protein, 58 aa, Artificial Sequence
  Description of Artificial Sequence: Synthetic polypeptide
MHSFCAFKADGGRCRGAHPRWFFNIFTRQCEEFSYGGCGGNQNRFESLEECKKMCTRD

SEQ ID NO: 12 - protein, 58 aa, Artificial Sequence
  Description of Artificial Sequence: Synthetic polypeptide
MHSFCAFKADDGPCRAAHPRWFFNIFTRQCEEFSYGGCGGNQNRFESLEECKKMCTRD

SEQ ID NO: 13 - protein, 58 aa, Artificial Sequence
  Description of Artificial Sequence: Synthetic polypeptide
MHSFCAFKADVGRCRGAHPRWFFNIFTRQCEEFSYGGCGGNQNRFESLEECKKMCTRD

SEQ ID NO: 14 - protein, 58 aa, Artificial Sequence
  Description of Artificial Sequence: Synthetic polypeptide
MHSFCAFKADVGRCRGAQPRFFFNIFTRQCEEFSYGGCGGNQNRFESLEECKKMCTRD

SEQ ID NO: 15 - protein, 58 aa, Artificial Sequence
  Description of Artificial Sequence: Synthetic polypeptide
MHSFCAFKADDGSCRAAHLRWFFNIFTRQCEEFSYGGCGGNQNRFESLEECKKMCTRD

SEQ ID NO: 16 - protein, 58 aa, Artificial Sequence
  Description of Artificial Sequence: Synthetic polypeptide
MHSFCAFKAEGGSCRAAHQRWFFNIFTRQCEEFSYGGCGGNQNRFESLEECKKMCTRD

SEQ ID NO: 17 - protein, 58 aa, Artificial Sequence
  Description of Artificial Sequence: Synthetic polypeptide
MHSFCAFKADDGPCRGAHLRFFFNIFTRQCEEFSYGGCGGNQNRFESLEECKKMCTRD

SEQ ID NO: 18 - protein, 58 aa, Artificial Sequence
  Description of Artificial Sequence: Synthetic polypeptide
MHSFCAFKADDGHCRGALPRWFFNIFTRQCEEFSYGGCGGNQNRFESLEECKKMCTRD

SEQ ID NO: 19 - protein, 58 aa, Artificial Sequence
  Description of Artificial Sequence: Synthetic polypeptide
MHSFCAFKADSGNCRGNLPRFFFNIFTRQCEEFSYGGCGGNQNRFESLEECKKMCTRD

SEQ ID NO: 20 - protein, 58 aa, Artificial Sequence
  Description of Artificial Sequence: Synthetic polypeptide
MHSFCAFKADSGRCRGNHQRFFFNIFTRQCEEFSYGGCGGNQNRFESLEECKKMCTRD

SEQ ID NO: 21 - protein, 58 aa, Artificial Sequence
  Description of Artificial Sequence: Synthetic polypeptide
MHSFCAFKADGGRCRAIQPRWFFNIFTRQCEEFSYGGCGGNQNRFESLEECKKMCTRD

SEQ ID NO: 22 - protein, 58 aa, Artificial Sequence
  Description of Artificial Sequence: Synthetic polypeptide
MHSFCAFKADDGRCRGAHPRWFFNIFTRQCEEFSYGGCGGNQNRFESLEECKKMCTRD

SEQ ID NO: 23 - protein, 638 aa, Homo sapiens
MILFKQATYFISLFATVSCGCLTQLYENAFFRGGDVASMYTPNAQYCQMRCTFHPRCLLFSFLPASSINDMEKRFGCFLKDSVTGTLPKVHRTGAVSGHSLKQCGHQISACHRDIYKGVDMRGVNFNVSKVSSVEECQKRCTSNIRCQFFSYATQTFHKAEYRNNCLLKYSPGGTPTAIKVLSNVESGFSLKPCALSEIGCHMNIFQHLAFSDVDVARVLTPDAFVCRTICTYHPNCLFFTFYTNVWKIESQRNVCLLKTSESGTPSSSTPQENTISGYSLLTCKRTLPEPCHSKIYPGVDFGGEELNVTFVKGVNVCQETCTKMIRCQFFTYSLLPEDCKEEKCKCFLRLSMDGSPTRIAYGTQGSSGYSLRLCNTGDNSVCTTKTSTRIVGGTNSSWGEWPWQVSLQVKLTAQRHLCGGSLIGHQWVLTAAHCFDGLPLQDVWRIYSGILNLSDITKDTPFSQIKEIIIHQNYKVSEGNHDIALIKLQAPLNYTEFQKPICLPSKGDTSTIYTNCWVTGWGFSKEKGEIQNILQKVNIPLVTNEECQKRYQDYKITQRMVCAGYKEGGKDACKGDSGGPLVCKHNGMWRLVGITSWGEGCARREQPGVYTKVAEYMDWILEKTQSSDGKAQMQSPA

SEQ ID NO: 24 - protein, 262 aa, Homo sapiens
MWFLVLCLALSLGGTGAAPPIQSRIVGGWECEQHSQPWQAALYHFSTFQCGGILVHRQWVLTAAHCISDNYQLWLGRHNLFDDENTAQFVHVSESFPHPGFNMSLLENHTRQADEDYSHDLMLLRLTEPADTITDAVKVVELPTQEPEVGSTCLASGWGSIEPENFSFPDDLQCVDLKILPNDECKKVHVQKVTDFMLCVGHLEGGKDTCVGDSGGPLMCDGVLQGVTSWGYVPCGTPNKPSVAVRVLSYVKWIEDTIAENS

SEQ ID NO: 25 - protein, 58 aa, Artificial Sequence
  Description of Artificial Sequence: Synthetic polypeptide
  MOD_RES (10)..(11): Any amino acid except Cys
  MOD_RES (13)..(13): Any amino acid except Cys
  MOD_RES (15)..(19): Any amino acid except Cys
  MOD_RES (21)..(21): Any amino acid except Cys
  MOD_RES (31)..(32): Any amino acid except Cys
  MOD_RES (34)..(35): Any amino acid except Cys
  MOD_RES (39)..(39): Any amino acid except Cys
MHSFCAFKAXXGXCXXXXXRXFFNIFTRQCXXFXXGGCXGNQNRFESLEECKKMCTRD

SEQ ID NO: 26 - protein, 619 aa, Homo sapiens
GCLTQLYENAFFRGGDVASMYTPNAQYCQMRCTFHPRCLLFSFLPASSINDMEKRFGCFLKDSVTGTLPKVHRTGAVSGHSLKQCGHQISACHRDIYKGVDMRGVNFNVSKVSSVEECQKRCTSNIRCQFFSYATQTFHKAEYRNNCLLKYSPGGTPTAIKVLSNVESGFSLKPCALSEIGCHMNIFQHLAFSDVDVARVLTPDAFVCRTICTYHPNCLFFTFYTNVWKIESQRNVCLLKTSESGTPSSSTPQENTISGYSLLTCKRTLPEPCHSKIYPGVDFGGEELNVTFVKGVNVCQETCTKMIRCQFFTYSLLPEDCKEEKCKCFLRLSMDGSPTRIAYGTQGSSGYSLRLCNTGDNSVCTTKTSTRIVGGTNSSWGEWPWQVSLQVKLTAQRHLCGGSLIGHQWVLTAAHCFDGLPLQDVWRIYSGILNLSDITKDTPFSQIKEIIIHQNYKVSEGNHDIALIKLQAPLNYTEFQKPICLPSKGDTSTIYTNCWVTGWGFSKEKGEIQNILQKVNIPLVTNEECQKRYQDYKITQRMVCAGYKEGGKDACKGDSGGPLVCKHNGMWRLVGITSWGEGCARREQPGVYTKVAEYMDWILEKTQSSDGKAQMQSPA

SEQ ID NO: 27 - DNA, 548 bp, Artificial Sequence
  Description of Artificial Sequence: Synthetic polynucleotide
  CDS (54)..(488)
cgacttttaacgacaacttgagaagatcaaaaaacaactaattattcgaaacgatgagattcccatctatcttcactgctgttttgttcgctgcttcctctgctttggctgctccagttaacaccactactgaagacgagactgctcaaattcctgctgaggctgtcatcggttactctgacttggaaggtgacttcgacgtcgctgttttgccattctctaactctactaacaacggtttgttgttcatcaacactaccatcgcttctatcgctgctaaggaggaaggtgtttccctcgagaagagagaggctatgcactctttctgtgctttcaaggctgacgacggtccgtgcagagctgctcacccaagatggttcttcaacatcttcacgcgtcaatgcgaggagttcatctacggtggttgtgagggtaaccaaaacagattcgagtctctagaggagtgtaagaagatgtgtactagagactagtaagaattcgccttagacatgactgttcctcagttcaagttgggcacttacgagaag

SEQ ID NO: 28 - protein, 638 aa, Homo sapiens; identical to SEQ ID NO: 23

SEQ ID NO: 29 - protein, 58 aa, Unknown [sequence omitted]

SEQ ID NO: 30 - protein, 58 aa, Unknown
  Description of Unknown: Kunitz domain polypeptide
KEDSCQLGYSAGPCMGMTSRYFYNGTSMACETFQYGGCMGNGNNFVTEKECLQTCRTV

SEQ ID NO: 31 - protein, 58 aa, Unknown
  Description of Unknown: Kunitz domain polypeptide
TVAACNLPIVRGPCRAFIQLWAFDAVKGKCVLFPYGGCQGNGNKFYSEKECREYCGVP

SEQ ID NO: 32 - protein, 58 aa, Homo sapiens
MHSFCAFKADDGPCKAIMKRFFFNIFTRQCEEFIYGGCEGNQNRFESLEECKKMCTRD

SEQ ID NO: 33 - protein, 58 aa, Unknown
  Description of Unknown: Kunitz domain polypeptide
KPDFCFLEEDPGICRGYITRYFYNNQTKQCERFKYGGCLGNMNNFETLEECKNICEDG

SEQ ID NO: 34 - protein, 58 aa, Unknown
  Description of Unknown: Kunitz domain polypeptide
GPSWCLTPADRGLCRANENRFYYNSVIGKCRPFKYSGCGGNENNFTSKQECLRACKKG

SEQ ID NO: 35 - protein, 58 aa, Unknown
  Description of Unknown: Kunitz domain polypeptide
LPNVCAFPMEKGPCQTYMTRWFFNFETGECELFAYGGCGGNSNNFLRKEKCEKFCKFT

SEQ ID NO: 36 - protein, 58 aa, Unknown
  Description of Unknown: Kunitz domain polypeptide
ETDICKLPKDEGTCRDFILKWYYDPNTKSCARFWYGGCGGNENKFGSQKECEKVCAPV

SEQ ID NO: 37 - protein, 58 aa, Unknown
  Description of Unknown: Kunitz domain polypeptide
NAEICLLPLDYGPCRALLLRYYYDRYTQSCRQFLYGGCEGNANNFYTWEACDDACWRI

SEQ ID NO: 38 - protein, 61 aa, Unknown
  Description of Unknown: Kunitz domain polypeptide
VPKVCRLQVSVDDQCEGSTEKYFFNLSSMTCEKFFSGGCHRNRIENRFPDEATCMGFCAPK

SEQ ID NO: 39 - protein, 58 aa, Unknown
  Description of Unknown: Kunitz domain polypeptide
IPSFCYSPKDEGLCSANVTRYYFNPRYRTCDAFTYTGCGGNDNNFVSREDCKRACAKA

SEQ ID NO: 40 - protein, 59 aa, Unknown
  Description of Unknown: Kunitz domain polypeptide
RNREVCSEQAETGPCRAMISRWYFDVTEGKCAPFFYGGCGGNRNNFDTEEYCMAVCGSA

SEQ ID NO: 41 - protein, 58 aa, Unknown
  Description of Unknown: Kunitz domain polypeptide
RPDFCLEPPYTGPCVAMFPRYFYNAKAGLCQTFVYGGCMGNGNNFKSAEDCMRTCGGA

SEQ ID NO: 42 - protein, 58 aa, Unknown
  Description of Unknown: Kunitz domain polypeptide
RPDFCQLGYSAGPCVAMFPRYFYNGTSMACQTFVYGGCMGNGNNFVTEKDCLQTCRGA

SEQ ID NO: 43 - protein, 58 aa, Unknown
  Description of Unknown: Kunitz domain polypeptide
RPDFCQLGYSAGPCVAMFPRYFYNGASMACQTFVYGGCMGNGNNFVTEKDCLQTCRGA

SEQ ID NO: 44 - protein, 58 aa, Unknown
  Description of Unknown: Kunitz domain polypeptide
RPDFCQLGYSAGPCVAMFPRYFYNGTSMACETFVYGGCMGNGNNFVTEKDCLQTCRGA

SEQ ID NO: 45 - protein, 58 aa, Unknown
  Description of Unknown: Kunitz domain polypeptide
RPDFCQLGYSAGPCVGMFSRYFYNGTSMACQTFVYGGCMGNGNNFVTEKDCLQTCRGA

SEQ ID NO: 46 - protein, 62 aa, Unknown
  Description of Unknown: Kunitz domain polypeptide
EAEARPDFCLEPPYTGPCIAFFPRYFYNAKAGLCQTFVYGGCMGNGNNFKSAEDCMRTCGGA

SEQ ID NO: 47 - protein, 56 aa, Unknown
  Description of Unknown: Kunitz domain polypeptide
AACNLPIVRGPCIAFFPRWAFDAVKGKCVLFPYGGCQGNGNKFYSEKECREYCGVP

SEQ ID NO: 48 - protein, 56 aa, Unknown; identical to SEQ ID NO: 47
  Description of Unknown: Kunitz domain polypeptide

SEQ ID NO: 49 - protein, 56 aa, Unknown
  Description of Unknown: Kunitz domain polypeptide
EACNLPIVRGPCIAFFPRWAFDAVKGKCVLFPYGGCQGNGNKFYSEKECREYCGVP

SEQ ID NO: 50 - protein, 60 aa, Unknown
  Description of Unknown: Kunitz domain polypeptide
EAVREVCSEQAETGPCIAFFPRWYFDVTEGKCAPFFYGGCGGNRNNFDTEEYCMAVCGSA

SEQ ID NO: 51 - protein, 60 aa, Unknown
  Description of Unknown: Kunitz domain polypeptide
EANAEICLLPLDYGPCIAFFPRYYYDRYTQSCRQFLYGGCEGNANNFYTWEACDDACWRI

SEQ ID NO: 52 - protein, 60 aa, Unknown
  Description of Unknown: Kunitz domain polypeptide
EAKPDFCFLEEDPGICIGFFPRYFYNNQAKQCERFVYGGCLGNMNNFETLEECKNICEDG

SEQ ID NO: 53 - protein, 58 aa, Unknown
  Description of Unknown: Kunitz domain polypeptide
EAETDICKLPKDEGTCIAFFPRWYYDPNTKSCARFVYGGCGGNKFGSQKECEKVCAPV

SEQ ID NO: 54 - protein, 304 aa, Homo sapiens
MIYTMKKVHALWASVCLLLNLAPAPLNADSEEDEEHTIITDTELPPLKLMHSFCAFKADDGPCKAIMKRFFFNIFTRQCEEFIYGGCEGNQNRFESLEECKKMCTRDNANRIIKTTLQQEKPDFCFLEEDPGICRGYITRYFYNNQTKQCERFKYGGCLGNMNNFETLEECKNICEDGPNGFQVDNYGTQLNAVNNSLTPQSTKVPSLFEFHGPSWCLTPADRGLCRANENRFYYNSVIGKCRPFKYSGCGGNENNFTSKQECLRACKKGFIQRISKGGLIKTKRKRKKQRVKIAYEEIFVKNM

SEQ ID NO: 55 - protein, 58 aa, Artificial Sequence [sequence omitted]

SEQ ID NO: 56 - DNA, 2252 bp, Homo sapiens
agaacagcttgaagaccgttcatttttaagtgacaagagactcacctccaagaagcaattgtgttttcagaatgattttattcaagcaagcaacttatttcatttccttgtttgctacagtttcctgtggatgtctgactcaactctatgaaaacgccttcttcagaggtggggatgtagcttccatgtacaccccaaatgcccaatactgccagatgaggtgcacattccacccaaggtgtttgctattcagttttcttccagcaagttcaatcaatgacatggagaaaaggtttggttgcttcttgaaagatagtgttacaggaaccctgccaaaagtacatcgaacaggtgcagtttctggacattccttgaagcaatgtggtcatcaaataagtgcttgccatcgagacatttataaaggagttgatatgagaggagtcaattttaatgtgtctaaggttagcagtgttgaagaatgccaaaaaaggtgcaccagtaacattcgctgccagtttttttcatatgccacgcaaacatttcacaaggcagagtaccggaacaattgcctattaaagtacagtcccggaggaacacctaccgctataaaggtgctgagtaacgtggaatctggattctcactgaagccctgtgccctttcagaaattggttgccacatgaacatcttccagcatcttgcgttctcagatgtggatgttgccagggttctcactccagatgcttttgtgtgtcggaccatctgcacctatcaccccaactgcctcttctttacattctatacaaatgtatggaaaatcgagtcacaaagaaatgtttgtcttcttaaaacatctgaaagtggcacaccaagttcctctactcctcaagaaaacaccatatctggatatagccttttaacctgcaaaagaactttacctgaaccctgccattctaaaatttacccgggagttgactttggaggagaagaattgaatgtgacttttgttaaaggagtgaatgtttgccaagagacttgcacaaagatgattcgctgtcagtttttcacttattctttactcccagaagactgtaaggaagagaagtgtaagtgtttcttaagattatctatggatggttctccaactaggattgcgtatgggacacaagggagctctggttactctttgagattgtgtaacactggggacaactctgtctgcacaacaaaaacaagcacacgcattgttggaggaacaaactcttcttggggagagtggccctggcaggtgagcctgcaggtgaagctgacagctcagaggcacctgtgtggagggtcactcataggacaccagtgggtcctcactgctgcccactgctttgatgggcttcccctgcaggatgtttggcgcatctatagtggcattttaaatctgtcagacattacaaaagatacacctttctcacaaataaaagagattattattcaccaaaactataaagtctcagaagggaatcatgatatcgccttgataaaactccaggctcctttgaattacactgaattccaaaaaccaatatgcctaccttccaaaggtgacacaagcacaatttataccaactgttgggtaaccggatggggcttctcgaaggagaaaggtgaaatccaaaatattctacaaaaggtaaatattcctttggtaacaaatgaagaatgccagaaaagatatcaagattataaaataacccaacggatggtctgtgctggctataaagaagggggaaaagatgcttgtaagggagattcaggtggtcccttagtttgcaaacacaatggaatgtggcgtttggtgggcatcaccagctggggtgaaggctgtgcccgcagggagcaacctggtgtctacaccaaagtcgctgagtacatggactggattttagagaaaacacagagcagtgatggaaaagctcagatgcagtcaccagcatgagaagcagtccagagtctaggcaatttttacaacctgagttcaagtcaaattctgagcctggggggtcctcatctgcaaagcatggagagtggcatcttctttgcatcctaaggacgaaaaacacagtgcactcagagctgctgaggacaatgtctggctgaagcccgctttcagcacgccgtaaccaggggctgacaatgcgaggtcgcaactgagatctccatgactgtgtgttgtgaaataaaatggtgaaagatcaaaaaa

SEQ ID NO: 57 - protein, 638 aa, Mus musculus
MILFNRVGYFVSLFATVSCGCMTQLYKNTFFRGGDLAAIYTPDAQYCQKMCTFHPRCLLFSFLAVTPPKETNKRFGCFMKESITGTLPRIHRTGAISGHSLKQCGHQISACHRDIYKGLDMRGSNFNISKTDNIEECQKLCTNNFHCQFFTYATSAFYRPEYRKKCLLKHSASGTPTSIKSADNLVSGFSLKSCALSEIGCPMDIFQHSAFADLNVSQVITPDAFVCRTICTFHPNCLFFTFYTNEWETESQRNVCFLKTSKSGRPSPPIPQENAISGYSLLTCRKTRPEPCHSKIYSGVDFEGEELNVTFVQGADVCQETCTKTIRCQFFIYSLLPQDCKEEGCKCSLRLSTDGSPTRITYGMQGSSGYSLRLCKLVDSPDCTTKINARIVGGTNASLGEWPWQVSLQVKLVSQTHLCGGSIIGRQWVLTAAHCFDGIPYPDVWRIYGGILSLSEITKETPSSRIKELIIHQEYKVSEGNYDIALIKLQTPLNYTEFQKPICLPSKADTNTIYTNCWVTGWGYTKEQGETQNILQKATIPLVPNEECQKKYRDYVINKQMICAGYKEGGTDACKGDSGGPLVCKHSGRWQLVGITSWGEGCGRKDQPGVYTKVSEYMDWILEKTQSSDVRALETSSA

SEQ ID NO: 58 - DNA, 2472 bp, Mus musculus
agaccgccctcggtgccatattcagagggcttgaagaccatcttcatgtgaagactccctctcctccagaaccacaacgtgaccatccttccaggatgattttattcaaccgagtgggttattttgtttccttgtttgctaccgtctcctgtgggtgtatgactcaactgtataaaaataccttcttcagaggtggggatctagctgccatctacaccccagatgcccagtactgtcagaagatgtgcacttttcaccccaggtgcctgctgttcagctttctcgccgtgactccacccaaagagacaaataaacggtttggttgcttcatgaaagagagcattacagggactttgccaagaatacaccggacaggggccatttctggtcattctttaaagcagtgtggccatcaaataagtgcttgccaccgagacatatacaaaggacttgatatgagagggtccaactttaatatctctaagaccgacaatattgaagaatgccagaaactgtgcacaaataattttcactgccaatttttcacatatgctacaagtgcattttacagaccagagtaccggaagaagtgcctgctgaagcacagtgcaagcggaacacccaccagcataaagtcagcggacaacctggtgtctggattctcactgaagtcctgtgcgctttcggagataggttgccccatggatattttccagcactctgcctttgcagacctgaatgtaagccaggtcatcacccccgatgcctttgtgtgtcgcaccatctgcaccttccatcccaactgccttttcttcacgttctacacgaatgaatgggagacagaatcacagagaaatgtttgttttcttaagacgtctaaaagtggaagaccaagtccccctattcctcaagaaaacgctatatctggatatagtctcctcacctgcagaaaaactcgccctgaaccctgccattccaaaatttactctggagttgactttgaaggggaagaactgaatgtgaccttcgtgcaaggagcagatgtctgccaagagacttgtacaaagacaatccgctgccagttttttatttactccttactcccccaagactgcaaggaggaggggtgtaaatgttccttaaggttatccacagatggctccccaactaggatcacctatggcatgcaggggagctccggttattctctgagattgtgtaaacttgtggacagccctgactgtacaacaaaaataaatgcacgtattgtgggaggaacaaacgcttctttaggggagtggccatggcaggtcagcctgcaagtgaagctggtatctcagacccatttgtgtggagggtccatcattggtcgccaatgggtactgacagctgcccattgctttgatggaattccctatccagatgtgtggcgtatatatggcggaattcttagtctgtccgagattacgaaagaaacgccttcctcgagaataaaggagcttattattcatcaggaatacaaagtctcagaaggcaattatgatattgccttaataaagcttcagacgcccctgaattatactgaattccaaaaaccaatatgcctgccttccaaagctgacacaaatacaatttataccaactgttgggtgactggatggggctacacgaaggaacaaggtgaaacgcaaaatattctacaaaaggctactattcctttggtaccaaatgaagaatgccagaaaaaatacagagattatgttataaacaagcagatgatctgtgctggctacaaagaaggcggaacagacgcttgtaagggagattccggtggccccttagtctgtaaacacagtggacggtggcagttggtgggtatcaccagctggggtgaaggctgcgcccgcaaggaccaaccaggagtctacaccaaagtttctgagtacatggactggatattggagaagacacagagcagtgatgtaagagctctggagacatcttcagcctgaggaggctgggtaccaaggaggaagaacccagctggctttaccacctgccctcaaggcaaactagagctccaggattctcggctgtaaaatgttgataatggtgtctacctcacatccgtatcattggattgaaaattcaagtgtagatatagttgctgaagacagcgttttgctcaagtgtgtttcctgccttgagtcacaggagctccaatgggagcattacaaagatcaccaagcttgttaggaaagagaatgatcaaagggttttattaggtaatgaaatgtctagatgtgatgcaattgaaaaaaagaccccagattctagcacagtccttgggaccattctcatgtaactgttgactctggacctcagcagatctcagagttacctgtccacttctgacatttgtttattagagcctgatgctattctttcaagtggagcaaaaaaaaaaaaaaa

SEQ ID NO: 59 - protein, 638 aa, Rattus norvegicus
MILFKQVGYFVSLFATVSCGCLSQLYANTFFRGGDLAAIYTPDAQHCQKMCTFHPRCLLFSFLAVSPTKETDKRFGCFMKESITGTLPRIHRTGAISGHSLKQCGHQLSACHQDIYEGLDMRGSNFNISKTDSIEECQKLCTNNIHCQFFTYATKAFHRPEYRKSCLLKRSSSGTPTSIKPVDNLVSGFSLKSCALSEIGCPMDIFQHFAFADLNVSHVVTPDAFVCRTVCTFHPNCLFFTFYTNEWETESQRNVCFLKTSKSGRPSPPIIQENAVSGYSLFTCRKARPEPCHFKIYSGVAFEGEELNATFVQGADACQETCTKTIRCQFFTYSLLPQDCKAEGCKCSLRLSTDGSPTRITYEAQGSSGYSLRLCKVVESSDCTTKINARIVGGTNSSLGEWPWQVSLQVKLVSQNHMCGGSIIGRQWILTAAHCFDGIPYPDVWRIYGGILNLSEITNKTPFSSIKELIIHQKYKMSEGSYDIALIKLQTPLNYTEFQKPICLPSKADTNTIYTNCWVTGWGYTKERGETQNILQKATIPLVPNEECQKKYRDYVITKQMICAGYKEGGIDACKGDSGGPLVCKHSGRWQLVGITSWGEGCARKEQPGVYTKVAEYIDWILEKIQSSKERALETSPA

SEQ ID NO: 60 - DNA, 2513 bp, Rattus norvegicus
tgaagactagcttcatgtgaagactccttctcctccagcagcacaaagcaaccatccttccaggatgattttattcaaacaagtgggttattttgtttccttgttcgctacagtttcctgtgggtgtctgtcacaactgtatgcaaataccttcttcagaggtggggatctggctgccatctacaccccggatgcccagcactgtcagaagatgtgcacgtttcaccccaggtgcctgctcttcagcttccttgccgtgagtccaaccaaggagacagataaaaggtttgggtgcttcatgaaagagagcattacagggactttgccaagaatacaccggacaggggccatttctggtcattctttaaaacagtgtggccatcaattaagtgcttgccaccaagacatatacgaaggactggatatgagagggtccaactttaatatatctaagaccgacagtattgaagaatgccagaaactgtgcacaaataatattcactgccaatttttcacatatgctacaaaagcatttcacagaccagagtacaggaagagttgcctgctgaagcgcagttcaagtggaacgcccaccagtataaagccagtggacaacctggtgtctggattctcactgaagtcctgtgctctctcagagatcggttgccccatggatattttccagcactttgcctttgcagacctgaatgtaagccatgtcgtcacccccgatgccttcgtgtgtcgcaccgtttgcaccttccatcccaactgcctcttcttcacattctacacgaatgagtgggagacggaatcacagaggaatgtttgttttcttaagacatctaaaagtggaagaccaagtccccctattattcaagaaaatgctgtatctggatacagtctcttcacctgcagaaaagctcgccctgaaccctgccatttcaagatttactctggagttgccttcgaaggggaagaactgaacgcgaccttcgtgcagggagcagatgcgtgccaagagacttgtacaaagaccatccgctgtcagttttttacttactcattgcttccccaagactgcaaggcagaggggtgtaaatgttccttaaggttatccacggatggctctccaactaggatcacctatgaggcacaggggagctctggttattctctgagactgtgtaaagttgtggagagctctgactgtacgacaaaaataaatgcacgtattgtgggaggaacaaactcttctttaggagagtggccatggcaggtcagcctgcaagtaaagttggtttctcagaatcatatgtgtggagggtccatcattggacgccaatggatactgacggctgcccattgctttgatgggattccctatccagacgtgtggcgtatatatggcgggattcttaatctgtcagagattacaaacaaaacgcctttctcaagtataaaggagcttattattcatcagaaatacaaaatgtcagaaggcagttacgatattgccttaataaagcttcagacaccgttgaattatactgaattccaaaaaccaatatgcctgccttccaaagctgacacaaatacaatttataccaactgctgggtgactggatggggctacacaaaggaacgaggtgagacccaaaatattctacaaaaggcaactattcccttggtaccaaatgaagaatgccagaaaaaatatagagattatgttataaccaagcagatgatctgtgctggctacaaagaaggtggaatagatgcttgtaagggagattccggtggccccttagtttgcaaacatagtggaaggtggcagttggtgggtatcaccagctggggcgaaggctgtgcccgcaaggagcaaccaggagtctacaccaaagttgctgagtacattgactggatattggagaagatacagagcagcaaggaaagagctctggagacatctccagcatgaggaggctgggtactgatggggaagagcccagctggcaccagctttaccacctgccctcaagtcctactagagctccagagttctcttctgcaaaatgtcgatagtggtgtctacctcgcatccttaccataggattaaaagtccaaatgtagacacagttgctaaagacagcgccatgctcaagcgtgcttcctgccttgagcaacaggaacgccaatgagaactatccaaagattaccaagcctgtttggaaataaaatggtcaaaggatttttattaggtagtgaaattaggtagttgtccttggaaccattctcatgtaactgttgactctggacctcagcagatcacagttaccttctgtccacttctgacatttgtgtactggaacctgatgctgttcttccacttggagcaaagaactgagaaacctggttctatccattgggaaaaagagatctttgtaacatttcctttacaataaaaagatgttctacttggacttgaaaaaaaaaaaaaaaaaaaaaaaaaa

SEQ ID NO: 61 - protein, 60 aa, Artificial Sequence
  Description of Artificial Sequence: Synthetic polypeptide
EAMHSFCAFKADDGPCRAAHPRWFFNIFTRQCEEFSYGGCGGNQNRFESLEECKKMCTRD

SEQ ID NO: 62 - protein, 11 aa, Artificial Sequence
  Description of Artificial Sequence: Synthetic peptide
RASQSIRNYLN

SEQ ID NO: 63 - protein, 14 aa, Artificial Sequence
  Description of Artificial Sequence: Synthetic peptide
TGTNSDVGNYNLVS

SEQ ID NO: 64 - protein, 11 aa, Artificial Sequence
  Description of Artificial Sequence: Synthetic peptide
SGDKLGDKYAC

SEQ ID NO: 65 - protein, 11 aa, Artificial Sequence
  Description of Artificial Sequence: Synthetic peptide
SGDKLGNKYAY

SEQ ID NO: 66 - protein, 11 aa, Artificial Sequence
  Description of Artificial Sequence: Synthetic peptide
RASQSISVYLN

SEQ ID NO: 67 - protein, 12 aa, Artificial Sequence
  Description of Artificial Sequence: Synthetic peptide
RASQSVSSSYLA

SEQ ID NO: 68 - protein, 11 aa, Artificial Sequence
  Description of Artificial Sequence: Synthetic peptide
SGNKLGDKYVA

SEQ ID NO: 69 - protein, 11 aa, Artificial Sequence
  Description of Artificial Sequence: Synthetic peptide
SGDQLGDKYVG

SEQ ID NO: 70 - protein, 11 aa, Artificial Sequence
  Description of Artificial Sequence: Synthetic peptide
SGDKLGDKYAC

SEQ ID NO: 71 - protein, 11 aa, Artificial Sequence
  Description of Artificial Sequence: Synthetic peptide
SGDQLGDKYVG

SEQ ID NO: 72 - protein, 11 aa, Artificial Sequence
  Description of Artificial Sequence: Synthetic peptide
SGNKLGDKYVA

SEQ ID NO: 73 - protein, 11 aa, Artificial Sequence
  Description of Artificial Sequence: Synthetic peptide
SGDNLGNKYNS

SEQ ID NO: 74 - protein, 11 aa, Artificial Sequence
  Description of Artificial Sequence: Synthetic peptide
RASQSVSSYLA

SEQ ID NO: 75 - protein, 11 aa, Artificial Sequence
  Description of Artificial Sequence: Synthetic peptide
SGEKLGDKYVS

SEQ ID NO: 76 - protein, 11 aa, Artificial Sequence
  Description of Artificial Sequence: Synthetic peptide
SGDKLGDKYTS

SEQ ID NO: 77 - protein, 13 aa, Artificial Sequence
  Description of Artificial Sequence: Synthetic peptide
SGSSSNIGSNTVS

SEQ ID NO: 78 - protein, 15 aa, Artificial Sequence
  Description of Artificial Sequence: Synthetic peptide
RSSQSLSDDGNTYLD

SEQ ID NO: 79 - protein, 16 aa, Artificial Sequence
  Description of Artificial Sequence: Synthetic peptide
RSSLSLLHSNGYNYLD

SEQ ID NO: 80 - protein, 13 aa, Artificial Sequence
  Description of Artificial Sequence: Synthetic peptide
SGNNSNFGSNTVT

SEQ ID NO: 81 - protein, 11 aa, Artificial Sequence
  Description of Artificial Sequence: Synthetic peptide
RASQPIDNYLN

SEQ ID NO: 82 - protein, 11 aa, Artificial Sequence
  Description of Artificial Sequence: Synthetic peptide
RASQSVSSYLA

SEQ ID NO: 83 - protein, 11 aa, Artificial Sequence
  Description of Artificial Sequence: Synthetic peptide
SGDKLGDKYTS

SEQ ID NO: 84 - protein, 11 aa, Artificial Sequence
  Description of Artificial Sequence: Synthetic peptide
RASGDIGNALG

SEQ ID NO: 85 - protein, 11 aa, Artificial Sequence
  Description of Artificial Sequence: Synthetic peptide
RASQSISSYLS

SEQ ID NO: 86 - protein, 11 aa, Artificial Sequence
  Description of Artificial Sequence: Synthetic peptide
RASQGISSYLA

SEQ ID NO: 87 - protein, 11 aa, Artificial Sequence
  Description of Artificial Sequence: Synthetic peptide
SGDKLGDKYVS

SEQ ID NO: 88 - protein, 11 aa, Artificial Sequence
  Description of Artificial Sequence: Synthetic peptide
RASQSISSWLA

SEQ ID NO: 89 - protein, 11 aa, Artificial Sequence
  Description of Artificial Sequence: Synthetic peptide
RASQPIDNYLN

SEQ ID NO: 90 - protein, 11 aa, Artificial Sequence
  Description of Artificial Sequence: Synthetic peptide
RASQPIDNYLN

SEQ ID NO: 91 - protein, 11 aa, Artificial Sequence
  Description of Artificial Sequence: Synthetic peptide
RASQPIDNYLN

SEQ ID NO: 92 - protein, 11 aa, Artificial Sequence
  Description of Artificial Sequence: Synthetic peptide
RASQPIDNYLN

SEQ ID NO: 93 - protein, 11 aa, Artificial Sequence
  Description of Artificial Sequence: Synthetic peptide
RASQPIDNYLN

SEQ ID NO: 94 - protein, 11 aa, Artificial Sequence
  Description of Artificial Sequence: Synthetic peptide
RASQPIDNYLN

SEQ ID NO: 95 - protein, 11 aa, Artificial Sequence
  Description of Artificial Sequence: Synthetic peptide
RASQPIDNYLN

SEQ ID NO: 96 - protein, 11 aa, Artificial Sequence
  Description of Artificial Sequence: Synthetic peptide
RASQPIDNYLN

SEQ ID NO: 97 - protein, 11 aa, Artificial Sequence
  Description of Artificial Sequence: Synthetic peptide
RASQPIDNYLN

SEQ ID NO: 98 - protein, 12 aa, Artificial Sequence
  Description of Artificial Sequence: Synthetic peptide
RTSQFVNSNYLA

SEQ ID NO: 99 - protein, 7 aa, Artificial Sequence
  Description of Artificial Sequence: Synthetic peptide
AASTLQS

SEQ ID NO: 100 - protein, 7 aa, Artificial Sequence
  Description of Artificial Sequence: Synthetic peptide
EVNKRPS

SEQ ID NO: 101 - protein, 7 aa, Artificial Sequence
  Description of Artificial Sequence: Synthetic peptide
QDSKRPS

SEQ ID NO: 102 - protein, 7 aa, Artificial Sequence
  Description of Artificial Sequence: Synthetic peptide
QDNNRPS

SEQ ID NO: 103 - protein, 7 aa, Artificial Sequence
  Description of Artificial Sequence: Synthetic peptide
GASNLQF

SEQ ID NO: 104 - protein, 7 aa, Artificial Sequence
  Description of Artificial Sequence: Synthetic peptide
GASSRAT

SEQ ID NO: 105 - protein, 7 aa, Artificial Sequence
  Description of Artificial Sequence: Synthetic peptide
QDTKRPS

SEQ ID NO: 106 - protein, 7 aa, Artificial Sequence
  Description of Artificial Sequence: Synthetic peptide
QDTKRPS

SEQ ID NO: 107 - protein, 7 aa, Artificial Sequence
  Description of Artificial Sequence: Synthetic peptide
QDSKRPS

SEQ ID NO: 108 - protein, 7 aa, Artificial Sequence
  Description of Artificial Sequence: Synthetic peptide
QDTKRPS

SEQ ID NO: 109 - protein, 7 aa, Artificial Sequence
  Description of Artificial Sequence: Synthetic peptide
QDTKRPS

SEQ ID NO: 110 - protein, 7 aa, Artificial Sequence
  Description of Artificial Sequence: Synthetic peptide
QDTKRPS

SEQ ID NO: 111 - protein, 7 aa, Artificial Sequence
  Description of Artificial Sequence: Synthetic peptide
DASNRAT

SEQ ID NO: 112 - protein, 7 aa, Artificial Sequence
  Description of Artificial Sequence: Synthetic peptide
EDSRRPS

SEQ ID NO: 113 - protein, 7 aa, Artificial Sequence
  Description of Artificial Sequence: Synthetic peptide
QDIKRPS

SEQ ID NO: 114 - protein, 7 aa, Artificial Sequence
  Description of Artificial Sequence: Synthetic peptide
NDHRRPS

SEQ ID NO: 115 - protein, 7 aa, Artificial Sequence
  Description of Artificial Sequence: Synthetic peptide
TLSYRAS

SEQ ID NO: 116 - protein, 7 aa, Artificial Sequence
  Description of Artificial Sequence: Synthetic peptide
LSSTRAS

SEQ ID NO: 117 - protein, 7 aa, Artificial Sequence
  Description of Artificial Sequence: Synthetic peptide
SDSRRPS

SEQ ID NO: 118 - protein, 7 aa, Artificial Sequence
  Description of Artificial Sequence: Synthetic peptide
AASRLQS

SEQ ID NO: 119 - protein, 7 aa, Artificial Sequence
  Description of Artificial Sequence: Synthetic peptide
DASNRAT

SEQ ID NO: 120 - protein, 7 aa, Artificial Sequence
  Description of Artificial Sequence: Synthetic peptide
QDIKRPS

SEQ ID NO: 121 - protein, 7 aa, Artificial Sequence
  Description of Artificial Sequence: Synthetic peptide
DASTLQS

SEQ ID NO: 122 - protein, 7 aa, Artificial Sequence
  Description of Artificial Sequence: Synthetic peptide
AASSLQS

SEQ ID NO: 123 - protein, 7 aa, Artificial Sequence
  Description of Artificial Sequence: Synthetic peptide
AASTLQS

SEQ ID NO: 124 - protein, 7 aa, Artificial Sequence
  Description of Artificial Sequence: Synthetic peptide
QDTKRPS

SEQ ID NO: 125 - protein, 7 aa, Artificial Sequence
  Description of Artificial Sequence: Synthetic peptide
KASTLES

SEQ ID NO: 126 - protein, 7 aa, Artificial Sequence
  Description of Artificial Sequence: Synthetic peptide
AASRLQS

SEQ ID NO: 127 - protein, 7 aa, Artificial Sequence
  Description of Artificial Sequence: Synthetic peptide
AASRLQS

SEQ ID NO: 128 - protein, 7 aa, Artificial Sequence
  Description of Artificial Sequence: Synthetic peptide
AASRLQS

SEQ ID NO: 129 - protein, 7 aa, Artificial Sequence
  Description of Artificial Sequence: Synthetic peptide
AASRLQS

SEQ ID NO: 130 - protein, 7 aa, Artificial Sequence
  Description of Artificial Sequence: Synthetic peptide
AASRLQS

SEQ ID NO: 131 - protein, 7 aa, Artificial Sequence
  Description of Artificial Sequence: Synthetic peptide
AASRLQS

SEQ ID NO: 132 - protein, 7 aa, Artificial Sequence
  Description of Artificial Sequence: Synthetic peptide
AASRLQS

SEQ ID NO: 133 - protein, 7 aa, Artificial Sequence
  Description of Artificial Sequence: Synthetic peptide
AASRLQS

SEQ ID NO: 134 - protein, 7 aa, Artificial Sequence
  Description of Artificial Sequence: Synthetic peptide
AASRLQS

SEQ ID NO: 135 - protein, 7 aa, Artificial Sequence
  Description of Artificial Sequence: Synthetic peptide
GASSRAT

SEQ ID NO: 136 - protein, 9 aa, Artificial Sequence
  Description of Artificial Sequence: Synthetic peptide
QQLSGYPHT

SEQ ID NO: 137 - protein, 11 aa, Artificial Sequence
  Description of Artificial Sequence: Synthetic peptide
CSYAGNRNFYV

SEQ ID NO: 138 - protein, 9 aa, Artificial Sequence
  Description of Artificial Sequence: Synthetic peptide
QAWDSSTGV

SEQ ID NO: 139 - protein, 9 aa, Artificial Sequence
  Description of Artificial Sequence: Synthetic peptide
QAWDSRTVV

SEQ ID NO: 140 - protein, 8 aa, Artificial Sequence
  Description of Artificial Sequence: Synthetic peptide
QQTFSLFT

SEQ ID NO: 141 - protein, 9 aa, Artificial Sequence
  Description of Artificial Sequence: Synthetic peptide
QQYGSSPFT

SEQ ID NO: 142 - protein, 9 aa, Artificial Sequence
  Description of Artificial Sequence: Synthetic peptide
QAWDSSIVI

SEQ ID NO: 143 - protein, 9 aa, Artificial Sequence
  Description of Artificial Sequence: Synthetic peptide
QAWDTSTAG

SEQ ID NO: 144 - protein, 9 aa, Artificial Sequence
  Description of Artificial Sequence: Synthetic peptide
QAWDSSTGV

SEQ ID NO: 145 - protein, 9 aa, Artificial Sequence
  Description of Artificial Sequence: Synthetic peptide
QAWDTSTAG

SEQ ID NO: 146 - protein, 9 aa, Artificial Sequence
  Description of Artificial Sequence: Synthetic peptide
QAWDSSIVI

SEQ ID NO: 147 - protein, 8 aa, Artificial Sequence
  Description of Artificial Sequence: Synthetic peptide
QAWDGNVV

SEQ ID NO: 148 - protein, 11 aa, Artificial Sequence
  Description of Artificial Sequence: Synthetic peptide
QQRSNWPRGFT

SEQ ID NO: 149 - protein, 9 aa, Artificial Sequence
  Description of Artificial Sequence: Synthetic peptide
QAWDSSTAI

SEQ ID NO: 150 - protein, 10 aa, Artificial Sequence
  Description of Artificial Sequence: Synthetic peptide
QAWDSPNARV

SEQ ID NO: 151 - protein, 11 aa, Artificial Sequence
  Description of Artificial Sequence: Synthetic peptide
SAWDDSLNGVV

SEQ ID NO: 152 - protein, 9 aa, Artificial Sequence
  Description of Artificial Sequence: Synthetic peptide
MQGTHWPPT

SEQ ID NO: 153 - protein, 9 aa, Artificial Sequence
  Description of Artificial Sequence: Synthetic peptide
MQPLETPPT

SEQ ID NO: 154 - protein, 10 aa, Artificial Sequence
  Description of Artificial Sequence: Synthetic peptide
AAWDDSLNGV

SEQ ID NO: 155 - protein, 9 aa, Artificial Sequence
  Description of Artificial Sequence: Synthetic peptide
QQSYTVPYT

SEQ ID NO: 156 - protein, 11 aa, Artificial Sequence
  Description of Artificial Sequence: Synthetic peptide
QQRSNWPRGFT

SEQ ID NO: 157 - protein, 10 aa, Artificial Sequence
  Description of Artificial Sequence: Synthetic peptide
QAWDSPNARV

SEQ ID NO: 158 - protein, 9 aa, Artificial Sequence
  Description of Artificial Sequence: Synthetic peptide
LQGYNYPRT

SEQ ID NO: 159 - protein, 9 aa, Artificial Sequence
  Description of Artificial Sequence: Synthetic peptide
QQSISIPRT

SEQ ID NO: 160 - protein, 9 aa, Artificial Sequence
  Description of Artificial Sequence: Synthetic peptide
QQLNSYPLT

SEQ ID NO: 161 - protein, 9 aa, Artificial Sequence
  Description of Artificial Sequence: Synthetic peptide
QAWDSSTYV

SEQ ID NO: 162 - protein, 8 aa, Artificial Sequence
  Description of Artificial Sequence: Synthetic peptide
QQYNTYWT

SEQ ID NO: 163 - protein, 9 aa, Artificial Sequence
  Description of Artificial Sequence: Synthetic peptide
QQSYTVPYT

SEQ ID NO: 164 - protein, 9 aa, Artificial Sequence
  Description of Artificial Sequence: Synthetic peptide
QQSYTVPYT

SEQ ID NO: 165 - protein, 9 aa, Artificial Sequence
  Description of Artificial Sequence: Synthetic peptide
QQSYTVPYT

SEQ ID NO: 166 - protein, 9 aa, Artificial Sequence
  Description of Artificial Sequence: Synthetic peptide
QQSYTVPYT

SEQ ID NO: 167 - protein, 9 aa, Artificial Sequence
  Description of Artificial Sequence: Synthetic peptide
QQSYTVPYT

SEQ ID NO: 168 - protein, 9 aa, Artificial Sequence
  Description of Artificial Sequence: Synthetic peptide
QQSYTVPYT

SEQ ID NO: 169 - protein, 9 aa, Artificial Sequence
  Description of Artificial Sequence: Synthetic peptide
QQSYTVPYT

SEQ ID NO: 170 - protein, 9 aa, Artificial Sequence
  Description of Artificial Sequence: Synthetic peptide
QQSYTVPYT

SEQ ID NO: 171 - protein, 9 aa, Artificial Sequence
  Description of Artificial Sequence: Synthetic peptide
QQSYTVPYT

SEQ ID NO: 172 - protein, 9 aa, Artificial Sequence
  Description of Artificial Sequence: Synthetic peptide
QQSSRTPWT

SEQ ID NO: 173 - protein, 5 aa, Artificial Sequence
  Description of Artificial Sequence: Synthetic peptide
FYYMV

SEQ ID NO: 174 - protein, 5 aa, Artificial Sequence
  Description of Artificial Sequence: Synthetic peptide
WYSMV

SEQ ID NO: 175 - protein, 5 aa, Artificial Sequence
  Description of Artificial Sequence: Synthetic peptide
WYLMI

SEQ ID NO: 176 - protein, 5 aa, Artificial Sequence
  Description of Artificial Sequence: Synthetic peptide
TYFML

SEQ ID NO: 177 - protein, 5 aa, Artificial Sequence
  Description of Artificial Sequence: Synthetic peptide
FYNMN

SEQ ID NO: 178 - protein, 5 aa, Artificial Sequence
  Description of Artificial Sequence: Synthetic peptide
PYNMY

SEQ ID NO: 179 - protein, 5 aa, Artificial Sequence
  Description of Artificial Sequence: Synthetic peptide
WYTMV

SEQ ID NO: 180 - protein, 5 aa, Artificial Sequence
  Description of Artificial Sequence: Synthetic peptide
WYTMV

SEQ ID NO: 181 - protein, 5 aa, Artificial Sequence
  Description of Artificial Sequence: Synthetic peptide
WYLMI

SEQ ID NO: 182 - protein, 5 aa, Artificial Sequence
  Description of Artificial Sequence: Synthetic peptide
WYTMV

SEQ ID NO: 183 - protein, 5 aa, Artificial Sequence
  Description of Artificial Sequence: Synthetic peptide
WYTMV

SEQ ID NO: 184 - protein, 5 aa, Artificial Sequence
  Description of Artificial Sequence: Synthetic peptide
WYEMG

SEQ ID NO: 185 - protein, 5 aa, Artificial Sequence
  Description of Artificial Sequence: Synthetic peptide
YYHMS

SEQ ID NO: 186 - protein, 5 aa, Artificial Sequence
  Description of Artificial Sequence: Synthetic peptide
YYMMV

SEQ ID NO: 187 - protein, 5 aa, Artificial Sequence
  Description of Artificial Sequence: Synthetic peptide
HYRMS

SEQ ID NO: 188 - protein, 5 aa, Artificial Sequence
  Description of Artificial Sequence: Synthetic peptide
RYEMY

SEQ ID NO: 189 - protein, 5 aa, Artificial Sequence
  Description of Artificial Sequence: Synthetic peptide
FYAMH

SEQ ID NO: 190 - protein, 5 aa, Artificial Sequence
  Description of Artificial Sequence: Synthetic peptide
YYEMD

SEQ ID NO: 191 - protein, 5 aa, Artificial Sequence
  Description of Artificial Sequence: Synthetic peptide
DYRMQ

SEQ ID NO: 192 - protein, 5 aa, Artificial Sequence
  Description of Artificial Sequence: Synthetic peptide
AYSMI

SEQ ID NO: 193 - protein, 5 aa, Artificial Sequence
  Description of Artificial Sequence: Synthetic peptide
YYHMS

SEQ ID NO: 194 - protein, 5 aa, Artificial Sequence
  Description of Artificial Sequence: Synthetic peptide
HYRMS

SEQ ID NO: 195 - protein, 5 aa, Artificial Sequence
  Description of Artificial Sequence: Synthetic peptide
RYIMH

SEQ ID NO: 196 - protein, 5 aa, Artificial Sequence
  Description of Artificial Sequence: Synthetic peptide
PYFMG

SEQ ID NO: 197 - protein, 5 aa, Artificial Sequence
  Description of Artificial Sequence: Synthetic peptide
HYLMT

SEQ ID NO: 198 - protein, 5 aa, Artificial Sequence
  Description of Artificial Sequence: Synthetic peptide
DYAMK

SEQ ID NO: 199 - protein, 5 aa, Artificial Sequence
  Description of Artificial Sequence: Synthetic peptide
HYIMM

SEQ ID NO: 200 - protein, 5 aa, Artificial Sequence
  Description of Artificial Sequence: Synthetic peptide
AYSMI

SEQ ID NO: 201 - protein, 5 aa, Artificial Sequence
  Description of Artificial Sequence: Synthetic peptide
AYSMI

SEQ ID NO: 202 - protein, 5 aa, Artificial Sequence
  Description of Artificial Sequence: Synthetic peptide
AYSMI

SEQ ID NO: 203 - protein, 5 aa, Artificial Sequence
  Description of Artificial Sequence: Synthetic peptide
AYSMI

SEQ ID NO: 204 - protein, 5 aa, Artificial Sequence
  Description of Artificial Sequence: Synthetic peptide
AYSMI

SEQ ID NO: 205 - protein, 5 aa, Artificial Sequence
  Description of Artificial Sequence: Synthetic peptide
AYSMI

SEQ ID NO: 206 - protein, 5 aa, Artificial Sequence
  Description of Artificial Sequence: Synthetic peptide
AYSMI

SEQ ID NO: 207 - protein, 5 aa, Artificial Sequence
  Description of Artificial Sequence: Synthetic peptide
AYSMI

SEQ ID NO: 208 - protein, 5 aa, Artificial Sequence
  Description of Artificial Sequence: Synthetic peptide
AYSMI

SEQ ID NO: 209 - protein, 5 aa, Artificial Sequence
  Description of Artificial Sequence: Synthetic peptide
HYLMT

SEQ ID NO: 210 - protein, 17 aa, Artificial Sequence
  Description of Artificial Sequence: Synthetic peptide
VIYPSGGITVYADSVKG

SEQ ID NO: 211 - protein, 17 aa, Artificial Sequence
  Description of Artificial Sequence: Synthetic peptide
SISPSGGLTNYADSVKG

SEQ ID NO: 212 - protein, 17 aa, Artificial Sequence
  Description of Artificial Sequence: Synthetic peptide
YIYPSGGFTYYADSVKG

SEQ ID NO: 213 - protein, 17 aa, Artificial Sequence
  Description of Artificial Sequence: Synthetic peptide
SIYPSGGNTVYADSVKG

SEQ ID NO: 214 - protein, 17 aa, Artificial Sequence
  Description of Artificial Sequence: Synthetic peptide
SISPSGGETNYADSVKG

SEQ ID NO: 215 - protein, 17 aa, Artificial Sequence
  Description of Artificial Sequence: Synthetic peptide
SIRPSGGGTVYADSVKG

SEQ ID NO: 216 - protein, 17 aa, Artificial Sequence
  Description of Artificial Sequence: Synthetic peptide
YIYPSGGATFYADSVKG

SEQ ID NO: 217 - protein, 17 aa, Artificial Sequence
  Description of Artificial Sequence: Synthetic peptide
RIYPSGGWTKYADSVKG

SEQ ID NO: 218 - protein, 17 aa, Artificial Sequence
  Description of Artificial Sequence: Synthetic peptide
YIYPSGGFTYYADSVKG

SEQ ID NO: 219 - protein, 17 aa, Artificial Sequence
  Description of Artificial Sequence: Synthetic peptide
RIYPSGGWTKYADSVKG

SEQ ID NO: 220 - protein, 17 aa, Artificial Sequence
  Description of Artificial Sequence: Synthetic peptide
YIYPSGGATFYADSVKG

SEQ ID NO: 221 - protein, 17 aa, Artificial Sequence
  Description of Artificial Sequence: Synthetic peptide
SIYSSGGGTMYADSVKG

SEQ ID NO: 222 - protein, 17 aa, Artificial Sequence
  Description of Artificial Sequence: Synthetic peptide
VISPSGGSTKYADSVKG

SEQ ID NO: 223 - protein, 17 aa, Artificial Sequence
  Description of Artificial Sequence: Synthetic peptide
YIYSSGGHTVYADSVKG

SEQ ID NO: 224 - protein, 17 aa, Artificial Sequence
  Description of Artificial Sequence: Synthetic peptide
SIYPSGGRTVYADSVKG

SEQ ID NO: 225 - protein, 17 aa, Artificial Sequence
  Description of Artificial Sequence: Synthetic peptide
SISSSGGPTAYADSVKG

SEQ ID NO: 226 - protein, 17 aa, Artificial Sequence
  Description of Artificial Sequence: Synthetic peptide
GIVPSGGRTHYADSVKG

SEQ ID NO: 227 - protein, 17 aa, Artificial Sequence
  Description of Artificial Sequence: Synthetic peptide
GISSSGGHTAYADSVKG

SEQ ID NO: 228 - protein, 17 aa, Artificial Sequence
  Description of Artificial Sequence: Synthetic peptide
VIVPSGGNTMYADSVKG

SEQ ID NO: 229 - protein, 17 aa, Artificial Sequence
  Description of Artificial Sequence: Synthetic peptide
YIRPSGGRTTYADSVKG

SEQ ID NO: 230 - protein, 17 aa, Artificial Sequence
  Description of Artificial Sequence: Synthetic peptide
VISPSGGSTKYADSVKG

SEQ ID NO: 231 - protein, 17 aa, Artificial Sequence
  Description of Artificial Sequence: Synthetic peptide
SIYPSGGRTVYADSVKG

SEQ ID NO: 232 - protein, 17 aa, Artificial Sequence
  Description of Artificial Sequence: Synthetic peptide
SISPSGGLTSYADSVKG

SEQ ID NO: 233 - protein, 17 aa, Artificial Sequence
  Description of Artificial Sequence: Synthetic peptide
GIGPSGGSTTYADSVKG

SEQ ID NO: 234 - protein, 17 aa, Artificial Sequence
  Description of Artificial Sequence: Synthetic peptide
YISPSGGHTIYADSVKG

SEQ ID NO: 235 - protein, 17 aa, Artificial Sequence
  Description of Artificial Sequence: Synthetic peptide
SISSSGGVTQYADSVKG

SEQ ID NO: 236 - protein, 17 aa, Artificial Sequence
  Description of Artificial Sequence: Synthetic peptide
GIYSSGGITVYADSVKG

SEQ ID NO: 237 - protein, 17 aa, Artificial Sequence
  Description of Artificial Sequence: Synthetic peptide
YIRPSGGRTTYADSVKG

SEQ ID NO: 238 - protein, 17 aa, Artificial Sequence
  Description of Artificial Sequence: Synthetic peptide
YIRPSGGRTTYADSVKG

SEQ ID NO: 239 - protein, 17 aa, Artificial Sequence
  Description of Artificial Sequence: Synthetic peptide
YIRPSGGRTTYADSVKG

SEQ ID NO: 240 - protein, 17 aa, Artificial Sequence
  Description of Artificial Sequence: Synthetic peptide
YIRPSGGRTTYADSVKG

SEQ ID NO: 241 - protein, 17 aa, Artificial Sequence
  Description of Artificial Sequence: Synthetic peptide
YIRPSGGRTTYADSVKG

SEQ ID NO: 242 - protein, 17 aa, Artificial Sequence
  Description of Artificial Sequence: Synthetic peptide
YIRPSGGRTTYADSVKG

SEQ ID NO: 243 - protein, 17 aa, Artificial Sequence
  Description of Artificial Sequence: Synthetic peptide
YIRPSGGRTTYADSVKG

SEQ ID NO: 244 - protein, 17 aa, Artificial Sequence
  Description of Artificial Sequence: Synthetic peptide
YIRPSGGRTTYADSVKG

SEQ ID NO: 245 - protein, 17 aa, Artificial Sequence
  Description of Artificial Sequence: Synthetic peptide
YIRPSGGRTTYADSVKG

SEQ ID NO: 246 - protein, 17 aa, Artificial Sequence
  Description of Artificial Sequence: Synthetic peptide
YISPSGGHTIYADSVKG

SEQ ID NO: 247 - protein, 16 aa, Artificial Sequence
  Description of Artificial Sequence: Synthetic peptide
DKWAVMPPYYYYAMDV

SEQ ID NO: 248 - protein, 14 aa, Artificial Sequence
  Description of Artificial Sequence: Synthetic peptide
HTAARPFYYYYMDV

SEQ ID NO: 249 - protein, 13 aa, Artificial Sequence
  Description of Artificial Sequence: Synthetic peptide
TEGPLSWGYGMDV

SEQ ID NO: 250 - protein, 15 aa, Artificial Sequence
  Description of Artificial Sequence: Synthetic peptide
AASPVRNYYYYGMDV

SEQ ID NO: 251 - protein, 15 aa, Artificial Sequence
  Description of Artificial Sequence: Synthetic peptide
GGGAYRNNWWGGFDI

SEQ ID NO: 252 - protein, 12 aa, Artificial Sequence
  Description of Artificial Sequence: Synthetic peptide
GFIAARWYYFDY

SEQ ID NO: 253 - protein, 13 aa, Artificial Sequence
  Description of Artificial Sequence: Synthetic peptide
GSYDYIWGFYSDH

SEQ ID NO: 254 - protein, 13 aa, Artificial Sequence
  Description of Artificial Sequence: Synthetic peptide
EGLLWFGENAFDI

SEQ ID NO: 255 - protein, 13 aa, Artificial Sequence
  Description of Artificial Sequence: Synthetic peptide
TEGPLSWGYGMDV

SEQ ID NO: 256 - protein, 13 aa, Artificial Sequence
  Description of Artificial Sequence: Synthetic peptide
EGLLWFGENAFDI

SEQ ID NO: 257 - protein, 13 aa, Artificial Sequence
  Description of Artificial Sequence: Synthetic peptide
GSYDYIWGFYSDH

SEQ ID NO: 258 - protein, 18 aa, Artificial Sequence
  Description of Artificial Sequence: Synthetic peptide
NPQYSGYDRSLSDGAFDI

SEQ ID NO: 259 - protein, 19 aa, Artificial Sequence
  Description of Artificial Sequence: Synthetic peptide
GGSSDYAWGSYRRPYYFDY

SEQ ID NO: 260 - protein, 15 aa, Artificial Sequence
  Description of Artificial Sequence: Synthetic peptide
DLFLYDFWSKGAFDI

SEQ ID NO: 261 - protein, 19 aa, Artificial Sequence
  Description of Artificial Sequence: Synthetic peptide
DKFEWRLLFRGIGNDAFDI

SEQ ID NO: 262 - protein, 20 aa, Artificial Sequence
  Description of Artificial Sequence: Synthetic peptide
GTPKWELLLRSIYIENAFDI

SEQ ID NO: 263 - protein, 12 aa, Artificial Sequence
  Description of Artificial Sequence: Synthetic peptide
DSSGSPNPLFDY

SEQ ID NO: 264 - protein, 16 aa, Artificial Sequence
  Description of Artificial Sequence: Synthetic peptide
ERRSSSRARYYYGMDV

SEQ ID NO: 265 - protein, 21 aa, Artificial Sequence
  Description of Artificial Sequence: Synthetic peptide
GGPGSSIAARRAPTGYYGMDV

SEQ ID NO: 266 - protein, 17 aa, Artificial Sequence
  Description of Artificial Sequence: Synthetic peptide
GGLLLWFRELKSNYFDY

SEQ ID NO: 267 - protein, 19 aa, Artificial Sequence
  Description of Artificial Sequence: Synthetic peptide
GGSSDYAWGSYRRPYYFDY

SEQ ID NO: 268 - protein, 19 aa, Artificial Sequence
  Description of Artificial Sequence: Synthetic peptide
DKFEWRLLFRGIGNDAFDI

SEQ ID NO: 269 - protein, 15 aa, Artificial Sequence
  Description of Artificial Sequence: Synthetic peptide
EFENAYHYYYYGMDV

SEQ ID NO: 270 - protein, 20 aa, Artificial Sequence
  Description of Artificial Sequence: Synthetic peptide
EGPPYSSGWYRGLRQYHFDY

SEQ ID NO: 271 - protein, 16 aa, Artificial Sequence
  Description of Artificial Sequence: Synthetic peptide
VARGIAARSRTSYFDY

SEQ ID NO: 272 - protein, 21 aa, Artificial Sequence
  Description of Artificial Sequence: Synthetic peptide
EEDYSSSWYSRRFDYYYGMDV

SEQ ID NO: 273 - protein, 13 aa, Artificial Sequence
  Description of Artificial Sequence: Synthetic peptide
RRTGIPRRDAFDI

SEQ ID NO: 274 - protein, 17 aa, Artificial Sequence
  Description of Artificial Sequence: Synthetic peptide
GGLLLWSRELKSNYFDY

SEQ ID NO: 275 - protein, 17 aa, Artificial Sequence
  Description of Artificial Sequence: Synthetic peptide
GGLLLWFMELKSNYFDY

SEQ ID NO: 276 - protein, 17 aa, Artificial Sequence
  Description of Artificial Sequence: Synthetic peptide
GGLLLWGRELKSNYFDY

SEQ ID NO: 277 - protein, 17 aa, Artificial Sequence
  Description of Artificial Sequence: Synthetic peptide
GGLLLWNRELKSNYFDY

SEQ ID NO: 278 - protein, 17 aa, Artificial Sequence
  Description of Artificial Sequence: Synthetic peptide
GGLLLWDRELKSNYFDY

SEQ ID NO: 279 - protein, 17 aa, Artificial Sequence
  Description of Artificial Sequence: Synthetic peptide
GGLLLWQRELKSNYFDY

SEQ ID NO: 280 - protein, 17 aa, Artificial Sequence
  Description of Artificial Sequence: Synthetic peptide
GGLLLWTRELKSNYFDY

SEQ ID NO: 281 - protein, 17 aa, Artificial Sequence
  Description of Artificial Sequence: Synthetic peptide
GGLLLWARELKSNYFDY

SEQ ID NO: 282 - protein, 17 aa, Artificial Sequence
  Description of Artificial Sequence: Synthetic peptide
GGLLLWERELKSNYFDY

SEQ ID NO: 283 - protein, 16 aa, Artificial Sequence
  Description of Artificial Sequence: Synthetic peptide
VARGIAARSRTSYFDY

SEQ ID NO: 284 - protein, 108 aa, Artificial Sequence
  Description of Artificial Sequence: Synthetic polypeptide
QDIQMTQSPSSLSASVGDRVTITCRASQSIRNYLNWYQQKPGKAPNLLIYAASTLQSGVPARFSGSGSGTDFTLTISSLQPEDFATYYCQQLSGYPHTFGQGTKLEIK

SEQ ID NO: 285 - protein, 142 aa, Artificial Sequence
  Description of Artificial Sequence: Synthetic polypeptide
EVQLLESGGGLVQPGGSLRLSCAASGFTFSFYYMVWVRQAPGKGLEWVSVIYPSGGITVYADSVKGRFTISRDNSKNTLYLQMNSLRAEDTAVYYCARDKWAVMPPYYYYAMDVWGQGTTVTVSSASTKGPSVFPLAPSSKS

SEQ ID NO: 286 - protein, 111 aa, Artificial Sequence
  Description of Artificial Sequence: Synthetic polypeptide
QSALTQPASVSGSPGQSITISCTGTNSDVGNYNLVSWYQQHPGEAPKLLIYEVNKRPSGVSNRFSGSKSGNTASLTISGLQAEDEADYLCCSYAGNRNFYVFGAGTKVTVL

SEQ ID NO: 287 - protein, 140 aa, Artificial Sequence
  Description of Artificial Sequence: Synthetic polypeptide
EVQLLESGGGLVQPGGSLRLSCAASGFTFSWYSMVWVRQAPGKGLEWVSSISPSGGLTNYADSVKGRFTISRDNSKNTLYLQMNSLRAEDTAVYYCARHTAARPFYYYYMDVWGKGTTVTVSSASTKGPSVFPLAPSSKS

SEQ ID NO: 288 - protein, 106 aa, Artificial Sequence
  Description of Artificial Sequence: Synthetic polypeptide
QSELTQPPSVSVSPGQTASITCSGDKLGDKYACWYQQKPGQSPVLVIYQDSKRPSGIPERFSGSNSGNTATLTISGTQAMDEADYYCQAWDSSTGVFGGGTKLTVL

SEQ ID NO: 289 - protein, 139 aa, Artificial Sequence
  Description of Artificial Sequence: Synthetic polypeptide
EVQLLESGGGLVQPGGSLRLSCAASGFTFSWYLMIWVRQAPGKGLEWVSYIYPSGGFTYYADSVKGRFTISRDNSKNTLYLQMNSLRAEDMAVYYCARTEGPLSWGYGMDVWGQGTTVTVSSASTKGPSVFPLAPSSKS

SEQ ID NO: 290 - protein, 106 aa, Artificial Sequence
  Description of Artificial Sequence: Synthetic polypeptide
QCELTQPPSESVSPGQTANITCSGDKLGNKYAYWYQQKPGQSPVLVIYQDNNRPSGIPERFSGSNSGNTATLTISGTQAIDEANYYCQAWDSRTVVFGGGTKLTVL

SEQ ID NO: 291 - protein, 141 aa, Artificial Sequence
  Description of Artificial Sequence: Synthetic polypeptide
EVQLLESGGGLVQPGGSLRLSCAASGFTFSTYFMLWVRQAPGKGLEWVSSIYPSGGNTVYADSVKGRFTISRDNSKNTLYLQMNSLRAEDTAVYYCARAASPVRNYYYYGMDVWGQGTTVTVSSASTKGPSVFPLAPSSKS

SEQ ID NO: 292 - protein, 107 aa, Artificial Sequence
  Description of Artificial Sequence: Synthetic polypeptide
QDIQMTQSPSSLSASVGDRVTITCRASQSISVYLNWYQHKPGKAPKLLIYGASNLQFGVPSRFSGSGYGTDFTLTISSLQPEDFATYHCQQTFSLFTFGGGTKVEIK

SEQ ID NO: 293 - protein, 141 aa, Artificial Sequence
  Description of Artificial Sequence: Synthetic polypeptide
EVQLLESGGGLVQPGGSLRLSCAASGFTFSFYNMNWVRQAPGKGLEWVSSISPSGGETNYADSVKGRFTISRDNSKNTLYLQMNSLRAEDTAVYYCARGGGAYRNNWWGGFDIWGLGTMVTVSSASTKGPSVFPLAPSSKS

SEQ ID NO: 294 - protein, 109 aa, Artificial Sequence
  Description of Artificial Sequence: Synthetic polypeptide
QDIQMTQSPGTLSLSPGERATLSCRASQSVSSSYLAWYQQKPGQAPRLLIYGASSRATGIPDRFSGSGSGTDFTLTISRLEPEDFAVYYCQQYGSSPFTFGPGTKVDIK

SEQ ID NO: 295 - protein, 138 aa, Artificial Sequence
  Description of Artificial Sequence: Synthetic polypeptide
EVQLLESGGGLVQPGGSLRLSCAASGFTFSPYNMYWVRQAPGKGLEWVSSIRPSGGGTVYADSVKGRFTISRDNSKNTLYLQMNSLRAEDTAVYYCAGGFIAARWYYFDYWGQGTLVTVSSASTKGPSVFPLAPSSKS

SEQ ID NO: 296 - protein, 106 aa, Artificial Sequence
  Description of Artificial Sequence: Synthetic polypeptide
QSALTQPPTVSVSPGQTARITCSGNKLGDKYVAWYQQKPGQSPMLVIYQDTKRPSRVSERFSGSNSANTATLSISGTQALDEADYYCQAWDSSIVIFGGGTRLTVL

SEQ ID NO: 297 - protein, 139 aa, Artificial Sequence
  Description of Artificial Sequence: Synthetic polypeptide
EVQLLESGGGLVQPGGSLRLSCAASGFTFSWYTMVWVRQAPGKGLEWVSYIYPSGGATFYADSVKGRFTISRDNSKNTLYLQMNSLRAEDTAVYYCAMGSYDYIWGFYSDHWGQGTLVTVSSASTKGPSVFPLAPSSKS

SEQ ID NO: 298 - protein, 106 aa, Artificial Sequence
  Description of Artificial Sequence: Synthetic polypeptide
QSVLTQPPSVSVSPGQTATITCSGDQLGDKYVGWYQQKPGQSPILVIYQDTKRPSGIPERFSGSNSGNTATLTISGTHTVDEAHYYCQAWDTSTAGFGGGTKLTVL

SEQ ID NO: 299 - protein, 139 aa, Artificial Sequence
  Description of Artificial Sequence: Synthetic polypeptide
EVQLLESGGGLVQPGGSLRLSCAASGFTFSWYTMVWVRQAPGKGLEWVSRIYPSGGWTKYADSVKGRFTISRDNSKNTLYLQMNSLRAEDTATYYCAREGLLWFGENAFDIWGQGTMVTVSSASTKGPSVFPLAPSSKS

SEQ ID NO: 300 - protein, 106 aa, Artificial Sequence; identical to SEQ ID NO: 288
  Description of Artificial Sequence: Synthetic polypeptide

SEQ ID NO: 301 - protein, 139 aa, Artificial Sequence; identical to SEQ ID NO: 289
  Description of Artificial Sequence: Synthetic polypeptide

SEQ ID NO: 302 - protein, 106 aa, Artificial Sequence; identical to SEQ ID NO: 298
  Description of Artificial Sequence: Synthetic polypeptide

SEQ ID NO: 303 - protein, 139 aa, Artificial Sequence; identical to SEQ ID NO: 299
  Description of Artificial Sequence: Synthetic polypeptide

SEQ ID NO: 304 - protein, 106 aa, Artificial Sequence; identical to SEQ ID NO: 296
  Description of Artificial Sequence: Synthetic polypeptide

SEQ ID NO: 305 - protein, 139 aa, Artificial Sequence; identical to SEQ ID NO: 297
  Description of Artificial Sequence: Synthetic polypeptide

SEQ ID NO: 306 - protein, 105 aa, Artificial Sequence
  Description of Artificial Sequence: Synthetic polypeptide
QYELTQPPSVSVSPGQTATITCSGDNLGNKYNSWYQQKPGQSPLLVIYQDTKRPSAIPERFSGSNSGNTATLTISGTQAMDEADYYCQAWDGNVVFGGGTKLTVL

SEQ ID NO: 307 - protein, 144 aa, Artificial Sequence
  Description of Artificial Sequence: Synthetic polypeptide
EVQLLESGGGLVQPGGSLRLSCAASGFTFSWYEMGWVRQAPGKGLEWVSSIYSSGGGTMYADSVKGRFTISRDNSKNTLYLQMNSLRAEDTAVYYCARNPQYSGYDRSLSDGAFDIWGQGTMVTVSSASTKGPSVFPLAPSSKS

SEQ ID NO: 308 - protein, 110 aa, Artificial Sequence
  Description of Artificial Sequence: Synthetic polypeptide
QDIQMTQSPATLSLSPGERATLSCRASQSVSSYLAWYQQKPGQAPRLLIYDASNRATGIPARFSGSGSGTDFTLTISSLEPEDFAVYYCQQRSNWPRGFTFGPGTKVDIK

SEQ ID NO: 309 - protein, 145 aa, Artificial Sequence
  Description of Artificial Sequence: Synthetic polypeptide
EVQLLESGGGLVQPGGSLRLSCAASGFTFSYYHMSWVRQAPGKGLEWVSVISPSGGSTKYADSVKGRFTISRDNSKNTLYLQMNSLRAEDTAVYYCARGGSSDYAWGSYRRPYYFDYWGQGTLVTVSSASTKGPSVFPLAPSSKS

SEQ ID NO: 310 - protein, 106 aa, Artificial Sequence
  Description of Artificial Sequence: Synthetic polypeptide
QSVLTQPPSVSVSPGQTASITCSGEKLGDKYVSWYQQKPGQSPSLVICEDSRRPSGIPERFSGSNSGNTATLTISGAQPMDEADYYCQAWDSSTAIFGPGTKVTVL

SEQ ID NO: 311 - protein, 141 aa, Artificial Sequence
  Description of Artificial Sequence: Synthetic polypeptide
EVQLLESGGGLVQPGGSLRLSCAASGFTFSYYMMVWVRQAPGKGLEWVSYIYSSGGHTVYADSVKGRFTISRDNSKNTLYLQMNSLRAEDTAVYYCARDLFLYDFWSKGAFDIWGQGTMVTVSSASTKGPSVFPLAPSSKS

SEQ ID NO: 312 - protein, 107 aa, Artificial Sequence
  Description of Artificial Sequence: Synthetic polypeptide
QSVLTQPPSVSVSPGQTASITCSGDKLGDKYTSWYQQRPGQSPVLVIYQDIKRPSGIPERFSGSNSGNTATLTISGTQAMDEADYYCQAWDSPNARVFGSGTKVTVL

SEQ ID NO: 313 - protein, 145 aa, Artificial Sequence
  Description of Artificial Sequence: Synthetic polypeptide
EVQLLESGGGLVQPGGSLRLSCAASGFTFSHYRMSWVRQAPGKGLEWVSSIYPSGGRTVYADSVKGRFTISRDNSKNTLYLQMNSLRAEDTAVYYCAKDKFEWRLLFRGIGNDAFDIWGQGTMVTVSSASTKGPSVFPLAPSSKS

SEQ ID NO: 314 - protein, 110 aa, Artificial Sequence
  Description of Artificial Sequence: Synthetic polypeptide
QSELTQPPSASETPGQRVTISCSGSSSNIGSNTVSWFQQLPGSAPRLLIYNDHRRPSGVPDRFSGSKSGTSASLVISGLQSQDEADYYCSAWDDSLNGVVFGGGTKLTVL

SEQ ID NO: 315 - protein, 146 aa, Artificial Sequence
  Description of Artificial Sequence: Synthetic polypeptide
EVQLLESGGGLVQPGGSLRLSCAASGFTFSRYEMYWVRQAPGKGLEWVSSISSSGGPTAYADSVKGRFTISRDNSKNTLYLQMNSLRAEDTAMYYCAKGTPKWELLLRSIYIENAFDIWGQGTMVTVSSASTKGPSVFPLAPSSKS

SEQ ID NO: 316 - protein, 112 aa, Artificial Sequence
  Description of Artificial Sequence: Synthetic polypeptide
QDIVMTQTPPSLPVNPGEPASISCRSSQSLSDDGNTYLDWYLQRPGQSPQLLIHTLSYRASGVPDRFSGSGSGTDFTLKISRVEAEDVGVYYCMQGTHWPPTFGQGTKVEIK

SEQ ID NO: 317 - protein, 138 aa, Artificial Sequence
  Description of Artificial Sequence: Synthetic polypeptide
EVQLLESGGGLVQPGGSLRLSCAASGFTFSFYAMHWVRQAPGKGLEWVSGIVPSGGRTHYADSVKGRFTISRDNSKNTLYLQMNSLRAEDTAVYYCATDSSGSPNPLFDYWGQGTLVTVSSASTKGPSVFPLAPSPKS

SEQ ID NO: 318 - protein, 113 aa, Artificial Sequence
  Description of Artificial Sequence: Synthetic polypeptide
QDIQMTQSPLSLSVTPGEPASISCRSSLSLLHSNGYNYLDWYVQRPGQSPQLLMYLSSTRASGVPDRFSGSGSGTDFTLEISRVEAEDVGVYYCMQPLETPPTFGGGTKVEIK

SEQ ID NO: 319 - protein, 142 aa, Artificial Sequence
  Description of Artificial Sequence: Synthetic polypeptide
EVQLLESGGGLVQPGGSLRLSCAASGFTFSYYEMDWVRQAPGKGLEWVSGISSSGGHTAYADSVKGRFTISRDNSKNTLYLQMNSLRAEDTATYYCARERRSSSRARYYYGMDVWGQGTTVTVSSASTKGPSVFPLAPSSKS

SEQ ID NO: 320 - protein, 109 aa, Artificial Sequence
  Description of Artificial Sequence: Synthetic polypeptide
QSVLIQPPSVSGIPGQRVTISCSGNNSNFGSNTVTWYQQLPGTAPKLLIYSDSRRPSGVPDRFSGSRSDTSASLAISGLQSEDEAEYHCAAWDDSLNGVFGGGTKLTVL

SEQ ID NO: 321 - protein, 147 aa, Artificial Sequence
  Description of Artificial Sequence: Synthetic polypeptide
EVQLLESGGGLVQPGGSLRLSCAASGFTFSDYRMQWVRQAPGKGLEWVSVIVPSGGNTMYADSVKGRFTISRDNSKNTLYLQMNSLRAEDTAVYYCARGGPGSSIAARRAPTGYYGMDVWGQGTTVTVSSASTKGPSVFPLAPSSKS

SEQ ID NO: 322 - protein, 108 aa, Artificial Sequence
  Description of Artificial Sequence: Synthetic polypeptide
QDIQMTQSPSSLSAFVGDRVTITCRASQPIDNYLNWYHQKPGKAPKLLIYAASRLQSGVPSRLSGSGFGTDFTLTISSLQPEDFGNYYCQQSYTVPYTFGGGTKVEIR

SEQ ID NO: 323 - protein, 143 aa, Artificial Sequence
  Description of Artificial Sequence: Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWFRELKSNYFDYWGQGTLVTVSSASTKGPSVFPLAPSSKS

SEQ ID NO: 324 - protein, 110 aa, Artificial Sequence; identical to SEQ ID NO: 308
  Description of Artificial Sequence: Synthetic polypeptide

SEQ ID NO: 325 - protein, 145 aa, Artificial Sequence; identical to SEQ ID NO: 309
  Description of Artificial Sequence: Synthetic polypeptide

SEQ ID NO: 326 - protein, 107 aa, Artificial Sequence; identical to SEQ ID NO: 312
  Description of Artificial Sequence: Synthetic polypeptide

SEQ ID NO: 327 - protein, 145 aa, Artificial Sequence; identical to SEQ ID NO: 313
  Description of Artificial Sequence: Synthetic polypeptide

SEQ ID NO: 328 - protein, 108 aa, Artificial Sequence
  Description of Artificial Sequence: Synthetic polypeptide
QDIQMTQSPSSLSASVGDRVTITCRASGDIGNALGWYQQKPGKAPRLLISDASTLQSGVPLRFSGSGSGTEFTLTISSLQPEDFATYYCLQGYNYPRTFGQGTKLEIR

SEQ ID NO: 329 - protein, 141 aa, Artificial Sequence
  Description of Artificial Sequence: Synthetic polypeptide
EVQLLESGGGLVQPGGSLRLSCAASGFTFSRYIMHWVRQAPGKGLEWVSSISPSGGLTSYADSVKGRFTISRDNSKNTLYLQMNSLRAEDTAVYYCAREFENAYHYYYYGMDVWGQGTTVTVSSASTKGPSVFPLAPSSKS

SEQ ID NO: 330 - protein, 108 aa, Artificial Sequence
  Description of Artificial Sequence: Synthetic polypeptide
QDIQMTQSPSSLSASVGDRVTITCRASQSISSYLSWYQQRPGKAPNLLIYAASSLQSGVPSRFSGSGSGTDFTLTISSLQPEDFATYYCQQSISIPRTFGQGTKVEVK

SEQ ID NO: 331 - protein, 146 aa, Artificial Sequence
  Description of Artificial Sequence: Synthetic polypeptide
EVQLLESGGGLVQPGGSLRLSCAASGFTFSPYFMGWVRQAPGKGLEWVSGIGPSGGSTTYADSVKGRFTISRDNSKNTLYLQMNSLRAEDTAVYYCAREGPPYSSGWYRGLRQYHFDYWGQGTLVTVSSASTKGPSVFPLAPSSKS

SEQ ID NO: 332 - protein, 108 aa, Artificial Sequence
  Description of Artificial Sequence: Synthetic polypeptide
QDIQMTQSPSFLSASVGDRVTITCRASQGISSYLAWYQQKPGKAPKLLIYAASTLQSGVPSRFSGSGSGTEFTLTISSLQPEDFATYYCQQLNSYPLTFGGGTKVEIK

SEQ ID NO: 333 - protein, 142 aa, Artificial Sequence
  Description of Artificial Sequence: Synthetic polypeptide
EVQLLESGGGLVQPGGSLRLSCAASGFTFSHYLMTWVRQAPGKGLEWVSYISPSGGHTIYADSVKGRFTISRDNSKNTLYLQMNSLRAEDTAVYYCARVARGIAARSRTSYFDYWGQGTLVTVSSASTKGPSVFPLAPSSKS

SEQ ID NO: 334 - protein, 106 aa, Artificial Sequence
  Description of Artificial Sequence: Synthetic polypeptide
QSALTQPPSVSVSPGQTASITCSGDKLGDKYVSWYQQRPGQSPVLVIYQDTKRPSGIPERFSGSNSGNTATLTISGTQAVDEADYYCQAWDSSTYVFGGGTKVTVL

SEQ ID NO: 335 - protein, 147 aa, Artificial Sequence
  Description of Artificial Sequence: Synthetic polypeptide
EVQLLESGGGLVQPGGSLRLSCAASGFTFSDYAMKWVRQAPGKGLEWVSSISSSGGVTQYADSVKGRFTISRDNSKNTLYLQMNSLRAEDTAVYYCAREEDYSSSWYSRRFDYYYGMDVWGQGTTVTVSSASTKGPSVFPLAPSSKS

SEQ ID NO: 336 - protein, 107 aa, Artificial Sequence
  Description of Artificial Sequence: Synthetic polypeptide
QDIQMTQSPSTLSASVGDRVTITCRASQSISSWLAWYQQKPGKAPNLLIYKASTLESGVPSRFSGSGSGTEFTLTISSLQPDDFATYYCQQYNTYWTFGQGTKVEIK

SEQ ID NO: 337 - protein, 139 aa, Artificial Sequence
  Description of Artificial Sequence: Synthetic polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRTGIPRRDAFDIWGQGTMVTVSSASTKGPSVFPLAPSSKS

SEQ ID NO: 338 - protein, 108 aa, Artificial Sequence; identical to SEQ ID NO: 322
  Description of Artificial Sequence: Synthetic polypeptide

SEQ ID NO: 339 - protein, 143 aa, Artificial Sequence
  Description of Artificial Sequence: Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWSRELKSNYFDYWGQGTLVTVSSASTKGPSVFPLAPSSKS

SEQ ID NO: 340 - protein, 108 aa, Artificial Sequence; identical to SEQ ID NO: 322
  Description of Artificial Sequence: Synthetic polypeptide

SEQ ID NO: 341 - protein, 143 aa, Artificial Sequence
  Description of Artificial Sequence: Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWMRELKSNYFDYWGQGTLVTVSSASTKGPSVFPLAPSSKS

SEQ ID NO: 342 - protein, 108 aa, Artificial Sequence; identical to SEQ ID NO: 322
  Description of Artificial Sequence: Synthetic polypeptide

SEQ ID NO: 343 - protein, 143 aa, Artificial Sequence
  Description of Artificial Sequence: Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWGRELKSNYFDYWGQGTLVTVSSASTKGPSVFPLAPSSKS

SEQ ID NO: 344 - protein, 108 aa, Artificial Sequence; identical to SEQ ID NO: 322
  Description of Artificial Sequence: Synthetic polypeptide

SEQ ID NO: 345 - protein, 143 aa, Artificial Sequence
  Description of Artificial Sequence: Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWNRELKSNYFDYWGQGTLVTVSSASTKGPSVFPLAPSSKS

SEQ ID NO: 346 - protein, 108 aa, Artificial Sequence; identical to SEQ ID NO: 322
  Description of Artificial Sequence: Synthetic polypeptide

SEQ ID NO: 347 - protein, 143 aa, Artificial Sequence
  Description of Artificial Sequence: Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWDRELKSNYFDYWGQGTLVTVSSASTKGPSVFPLAPSSKS

SEQ ID NO: 348 - protein, 108 aa, Artificial Sequence; identical to SEQ ID NO: 322
  Description of Artificial Sequence: Synthetic polypeptide

SEQ ID NO: 349 - protein, 143 aa, Artificial Sequence
  Description of Artificial Sequence: Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWQRELKSNYFDYWGQGTLVTVSSASTKGPSVFPLAPSSKS

SEQ ID NO: 350 - protein, 108 aa, Artificial Sequence; identical to SEQ ID NO: 322
  Description of Artificial Sequence: Synthetic polypeptide

SEQ ID NO: 351 - protein, 143 aa, Artificial Sequence
  Description of Artificial Sequence: Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWTRELKSNYFDYWGQGTLVTVSSASTKGPSVFPLAPSSKS

SEQ ID NO: 352 - protein, 108 aa, Artificial Sequence; identical to SEQ ID NO: 322
  Description of Artificial Sequence: Synthetic polypeptide

SEQ ID NO: 353 - protein, 143 aa, Artificial Sequence
  Description of Artificial Sequence: Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWARELKSNYFDYWGQGTLVTVSSASTKGPSVFPLAPSSKS

SEQ ID NO: 354 - protein, 108 aa, Artificial Sequence; identical to SEQ ID NO: 322
  Description of Artificial Sequence: Synthetic polypeptide

SEQ ID NO: 355 - protein, 143 aa, Artificial Sequence
  Description of Artificial Sequence: Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWERELKSNYFDYWGQGTLVTVSSASTKGPSVFPLAPSSKS

SEQ ID NO: 356 - protein, 17 aa, Artificial Sequence
  Description of Artificial Sequence: Synthetic peptide
GGLLLWFRELKSNYFDY

SEQ ID NO: 357 - protein, 17 aa, Artificial Sequence
  Description of Artificial Sequence: Synthetic peptide
GGLLLWFRELKSNYFDY

SEQ ID NO: 358 - protein, 14 aa, Artificial Sequence
  Description of Artificial Sequence: Synthetic peptide
GGLLLWFRELKSNY

SEQ ID NO: 359 - DNA, 42 bp, Artificial Sequence
  Description of Artificial Sequence: Synthetic primer
  modified_base (22)..(23): a, c, t, g, unknown or other
ggcggtctattactatggttcnnkgagctgaagtctaactac

SEQ ID NO: 360 - DNA, 42 bp, Artificial Sequence
  Description of Artificial Sequence: Synthetic primer
  modified_base (19)..(20): a, c, t, g, unknown or other
ggcggtctattactatggnnkagggagctgaagtctaactac

SEQ ID NO: 361 - DNA, 42 bp, Artificial Sequence
  Description of Artificial Sequence: Synthetic primer
  modified_base (16)..(17): a, c, t, g, unknown or other
ggcggtctattactannkttcagggagctgaagtctaactac

SEQ ID NO: 362 - DNA, 42 bp, Artificial Sequence
  Description of Artificial Sequence: Synthetic primer
  modified_base (25)..(26): a, c, t, g, unknown or other
ggcggtctattactatggttcaggnnkctgaagtctaactac

SEQ ID NO: 363 - protein, 17 aa, Artificial Sequence
  Description of Artificial Sequence: Synthetic peptide
GGLLLWFRELKSNYFDY

SEQ ID NO: 364 - protein, 17 aa, Artificial Sequence
  Description of Artificial Sequence: Synthetic peptide
GGLLLAFRELKSNYFDY

SEQ ID NO: 365 - protein, 17 aa, Artificial Sequence
  Description of Artificial Sequence: Synthetic peptide
GGLLLCFRELKSNYFDY

SEQ ID NO: 366 - protein, 17 aa, Artificial Sequence
  Description of Artificial Sequence: Synthetic peptide
GGLLLDFRELKSNYFDY

SEQ ID NO: 367 - protein, 17 aa, Artificial Sequence
  Description of Artificial Sequence: Synthetic peptide
GGLLLEFRELKSNYFDY

SEQ ID NO: 368 - protein, 17 aa, Artificial Sequence
  Description of Artificial Sequence: Synthetic peptide
GGLLLGFRELKSNYFDY

SEQ ID NO: 369 - protein, 17 aa, Artificial Sequence
  Description of Artificial Sequence: Synthetic peptide
GGLLLKFRELKSNYFDY

SEQ ID NO: 370 - protein, 17 aa, Artificial Sequence
  Description of Artificial Sequence: Synthetic peptide
GGLLLLFRELKSNYFDY

SEQ ID NO: 371 - protein, 17 aa, Artificial Sequence
  Description of Artificial Sequence: Synthetic peptide
GGLLLMFRELKSNYFDY

SEQ ID NO: 372 - protein, 17 aa, Artificial Sequence
  Description of Artificial Sequence: Synthetic peptide
GGLLLPFRELKSNYFDY

SEQ ID NO: 373 - protein, 17 aa, Artificial Sequence
  Description of Artificial Sequence: Synthetic peptide
GGLLLQFRELKSNYFDY

SEQ ID NO: 374 - protein, 17 aa, Artificial Sequence
  Description of Artificial Sequence: Synthetic peptide
GGLLLRFRELKSNYFDY

SEQ ID NO: 375 - protein, 17 aa, Artificial Sequence
  Description of Artificial Sequence: Synthetic peptide
GGLLLSFRELKSNYFDY

SEQ ID NO: 376 - protein, 17 aa, Artificial Sequence
  Description of Artificial Sequence: Synthetic peptide
GGLLLTFRELKSNYFDY

SEQ ID NO: 377 - protein, 17 aa, Artificial Sequence
  Description of Artificial Sequence: Synthetic peptide
GGLLLVFRELKSNYFDY

SEQ ID NO: 378 - protein, 17 aa, Artificial Sequence
  Description of Artificial Sequence: Synthetic peptide
GGLLLWARELKSNYFDY

SEQ ID NO: 379 - protein, 17 aa, Artificial Sequence
  Description of Artificial Sequence: Synthetic peptide
GGLLLWCRELKSNYFDY

SEQ ID NO: 380 - protein, 17 aa, Artificial Sequence
  Description of Artificial Sequence: Synthetic peptide
GGLLLWDRELKSNYFDY

SEQ ID NO: 381 - protein, 17 aa, Artificial Sequence
  Description of Artificial Sequence: Synthetic peptide
GGLLLWERELKSNYFDY

SEQ ID NO: 382 - protein, 17 aa, Artificial Sequence
  Description of Artificial Sequence: Synthetic peptide
GGLLLWGRELKSNYFDY

SEQ ID NO: 383 - protein, 17 aa, Artificial Sequence
  Description of Artificial Sequence: Synthetic peptide
GGLLLWKRELKSNYFDY

SEQ ID NO: 384 - protein, 17 aa, Artificial Sequence
  Description of Artificial Sequence: Synthetic peptide
GGLLLWLRELKSNYFDY

SEQ ID NO: 385 - protein, 17 aa, Artificial Sequence
  Description of Artificial Sequence: Synthetic peptide
GGLLLWMRELKSNYFDY

SEQ ID NO: 386 - protein, 17 aa, Artificial Sequence
  Description of Artificial Sequence: Synthetic peptide
GGLLLWNRELKSNYFDY

SEQ ID NO: 387 - protein, 17 aa, Artificial Sequence
  Description of Artificial Sequence: Synthetic peptide
GGLLLWPRELKSNYFDY

SEQ ID NO: 388 - protein, 17 aa, Artificial Sequence
  Description of Artificial Sequence: Synthetic peptide
GGLLLWQRELKSNYFDY

SEQ ID NO: 389 - protein, 17 aa, Artificial Sequence
  Description of Artificial Sequence: Synthetic peptide
GGLLLWRRELKSNYFDY

SEQ ID NO: 390 - protein, 17 aa, Artificial Sequence
  Description of Artificial Sequence: Synthetic peptide
GGLLLWSRELKSNYFDY

SEQ ID NO: 391 - protein, 17 aa, Artificial Sequence
  Description of Artificial Sequence: Synthetic peptide
GGLLLWTRELKSNYFDY

SEQ ID NO: 392 - protein, 17 aa, Artificial Sequence
  Description of Artificial Sequence: Synthetic peptide
GGLLLWWRELKSNYFDY

SEQ ID NO: 393 - protein, 17 aa, Artificial Sequence
  Description of Artificial Sequence: Synthetic peptide
GGLLLWYRELKSNYFDY

SEQ ID NO: 394 - protein, 17 aa, Artificial Sequence
  Description of Artificial Sequence: Synthetic peptide
GGLLLWFAELKSNYFDY

SEQ ID NO: 395 - protein, 17 aa, Artificial Sequence
  Description of Artificial Sequence: Synthetic peptide
GGLLLWFCELKSNYFDY

SEQ ID NO: 396 - protein, 17 aa, Artificial Sequence
  Description of Artificial Sequence: Synthetic peptide
GGLLLWFEELKSNYFDY

SEQ ID NO: 397 - protein, 17 aa, Artificial Sequence
  Description of Artificial Sequence: Synthetic peptide
GGLLLWFFELKSNYFDY

SEQ ID NO: 398 - protein, 17 aa, Artificial Sequence
  Description of Artificial Sequence: Synthetic peptide
GGLLLWFGELKSNYFDY

SEQ ID NO: 399 - protein, 17 aa, Artificial Sequence
  Description of Artificial Sequence: Synthetic peptide
GGLLLWFHELKSNYFDY

SEQ ID NO: 400 - protein, 17 aa, Artificial Sequence
  Description of Artificial Sequence: Synthetic peptide
GGLLLWFKELKSNYFDY

SEQ ID NO: 401 - protein, 17 aa, Artificial Sequence
  Description of Artificial Sequence: Synthetic peptide
GGLLLWFLELKSNYFDY

SEQ ID NO: 402 - protein, 17 aa, Artificial Sequence
  Description of Artificial Sequence: Synthetic peptide
GGLLLWFMELKSNYFDY

SEQ ID NO: 403 - protein, 17 aa, Artificial Sequence
  Description of Artificial Sequence: Synthetic peptide
GGLLLWFPELKSNYFDY

SEQ ID NO: 404 - protein, 17 aa, Artificial Sequence
  Description of Artificial Sequence: Synthetic peptide
GGLLLWFQELKSNYFDY

SEQ ID NO: 405 - protein, 17 aa, Artificial Sequence
  Description of Artificial Sequence: Synthetic peptide
GGLLLWFSELKSNYFDY

SEQ ID NO: 406 - protein, 17 aa, Artificial Sequence
  Description of Artificial Sequence: Synthetic peptide
GGLLLWFTELKSNYFDY

SEQ ID NO: 407 - protein, 17 aa, Artificial Sequence
  Description of Artificial Sequence: Synthetic peptide
GGLLLWFVELKSNYFDY

SEQ ID NO: 408 - protein, 17 aa, Artificial Sequence
  Description of Artificial Sequence: Synthetic peptide
GGLLLWFWELKSNYFDY

SEQ ID NO: 409 - protein, 17 aa, Artificial Sequence
  Description of Artificial Sequence: Synthetic peptide
GGLLLWFYELKSNYFDY

SEQ ID NO: 410 - protein, 17 aa, Artificial Sequence
  Description of Artificial Sequence: Synthetic peptide
GGLLLWFRALKSNYFDY

SEQ ID NO: 411 - protein, 17 aa, Artificial Sequence
  Description of Artificial Sequence: Synthetic peptide
GGLLLWFRCLKSNYFDY

SEQ ID NO: 412 - protein, 17 aa, Artificial Sequence
  Description of Artificial Sequence: Synthetic peptide
GGLLLWFRGLKSNYFDY

SEQ ID NO: 413 - protein, 17 aa, Artificial Sequence
  Description of Artificial Sequence: Synthetic peptide
GGLLLWFRHLKSNYFDY

SEQ ID NO: 414 - protein, 17 aa, Artificial Sequence
  Description of Artificial Sequence: Synthetic peptide
GGLLLWFRKLKSNYFDY

SEQ ID NO: 415 - protein, 17 aa, Artificial Sequence
  Description of Artificial Sequence: Synthetic peptide
GGLLLWFRLLKSNYFDY

SEQ ID NO: 416 - protein, 17 aa, Artificial Sequence
  Description of Artificial Sequence: Synthetic peptide
GGLLLWFRNLKSNYFDY

SEQ ID NO: 417 - protein, 17 aa, Artificial Sequence
  Description of Artificial Sequence: Synthetic peptide
GGLLLWFRPLKSNYFDY

SEQ ID NO: 418 - protein, 17 aa, Artificial Sequence
  Description of Artificial Sequence: Synthetic peptide
GGLLLWFRQLKSNYFDY

SEQ ID NO: 419 - protein, 17 aa, Artificial Sequence
  Description of Artificial Sequence: Synthetic peptide
GGLLLWFRRLKSNYFDY

SEQ ID NO: 420 - protein, 17 aa, Artificial Sequence
  Description of Artificial Sequence: Synthetic peptide
GGLLLWFRSLKSNYFDY

SEQ ID NO: 421 - protein, 17 aa, Artificial Sequence
  Description of Artificial Sequence: Synthetic peptide
GGLLLWFRTLKSNYFDY

SEQ ID NO: 422 - protein, 17 aa, Artificial Sequence
  Description of Artificial Sequence: Synthetic peptide
GGLLLWFRVLKSNYFDY

SEQ ID NO: 423 - protein, 17 aa, Artificial Sequence
  Description of Artificial Sequence: Synthetic peptide
GGLLLWFRWLKSNYFDY

SEQ ID NO: 424 - protein, 17 aa, Artificial Sequence
  Description of Artificial Sequence: Synthetic peptide
GGLLLWFRYLKSNYFDY

SEQ ID NO: 425 - protein, 108 aa, Artificial Sequence; identical to SEQ ID NO: 322
  Description of Artificial Sequence: Synthetic polypeptide

SEQ ID NO: 426 - protein, 143 aa, Artificial Sequence
  Description of Artificial Sequence: Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLAFRELKSNYFDYWGQGTLVTVSSASTKGPSVFPLAPSSKS

SEQ ID NO: 427 - protein, 108 aa, Artificial Sequence; identical to SEQ ID NO: 322
  Description of Artificial Sequence: Synthetic polypeptide

SEQ ID NO: 428 - protein, 143 aa, Artificial Sequence
  Description of Artificial Sequence: Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLCFRELKSNYFDYWGQGTLVTVSSASTKGPSVFPLAPSSKS

SEQ ID NO: 429 - protein, 108 aa, Artificial Sequence; identical to SEQ ID NO: 322
  Description of Artificial Sequence: Synthetic polypeptide

SEQ ID NO: 430 - protein, 143 aa, Artificial Sequence
  Description of Artificial Sequence: Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLDFRELKSNYFDYWGQGTLVTVSSASTKGPSVFPLAPSSKS

SEQ ID NO: 431 - protein, 108 aa, Artificial Sequence; identical to SEQ ID NO: 322
  Description of Artificial Sequence: Synthetic polypeptide

SEQ ID NO: 432 - protein, 143 aa, Artificial Sequence
  Description of Artificial Sequence: Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLEFRELKSNYFDYWGQGTLVTVSSASTKGPSVFPLAPSSKS

SEQ ID NO: 433 - protein, 108 aa, Artificial Sequence; identical to SEQ ID NO: 322
  Description of Artificial Sequence: Synthetic polypeptide

SEQ ID NO: 434 - protein, 143 aa, Artificial Sequence
  Description of Artificial Sequence: Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLGFRELKSNYFDYWGQGTLVTVSSASTKGPSVFPLAPSSKS

SEQ ID NO: 435 - protein, 108 aa, Artificial Sequence; identical to SEQ ID NO: 322
  Description of Artificial Sequence: Synthetic polypeptide

SEQ ID NO: 436 - protein, 143 aa, Artificial Sequence
  Description of Artificial Sequence: Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLKFRELKSNYFDYWGQGTLVTVSSASTKGPSVFPLAPSSKS

SEQ ID NO: 437 - protein, 108 aa, Artificial Sequence; identical to SEQ ID NO: 322
  Description of Artificial Sequence: Synthetic polypeptide

SEQ ID NO: 438 - protein, 143 aa, Artificial Sequence
  Description of Artificial Sequence: Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLLFRELKSNYFDYWGQGTLVTVSSASTKGPSVFPLAPSSKS

SEQ ID NO: 439 - protein, 108 aa, Artificial Sequence; identical to SEQ ID NO: 322
  Description of Artificial Sequence: Synthetic polypeptide

SEQ ID NO: 440 - protein, 143 aa, Artificial Sequence
  Description of Artificial Sequence: Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLMFRELKSNYFDYWGQGTLVTVSSASTKGPSVFPLAPSSKS

SEQ ID NO: 441 - protein, 108 aa, Artificial Sequence; identical to SEQ ID NO: 322
  Description of Artificial Sequence: Synthetic polypeptide

SEQ ID NO: 442 - protein, 143 aa, Artificial Sequence
  Description of Artificial Sequence: Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLPFRELKSNYFDYWGQGTLVTVSSASTKGPSVFPLAPSSKS

SEQ ID NO: 443 - protein, 108 aa, Artificial Sequence; identical to SEQ ID NO: 322
  Description of Artificial Sequence: Synthetic polypeptide

SEQ ID NO: 444 - protein, 143 aa, Artificial Sequence
  Description of Artificial Sequence: Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLQFRELKSNYFDYWGQGTLVTVSSASTKGPSVFPLAPSSKS

SEQ ID NO: 445 - protein, 108 aa, Artificial Sequence; identical to SEQ ID NO: 322
  Description of Artificial Sequence: Synthetic polypeptide

SEQ ID NO: 446 - protein, 143 aa, Artificial Sequence
  Description of Artificial Sequence: Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLRFRELKSNYFDYWGQGTLVTVSSASTKGPSVFPLAPSSKS

SEQ ID NO: 447 - protein, 108 aa, Artificial Sequence; identical to SEQ ID NO: 322
  Description of Artificial Sequence: Synthetic polypeptide

SEQ ID NO: 448 - protein, 143 aa, Artificial Sequence
  Description of Artificial Sequence: Synthetic polypeptide
EVQLLESGGGLVQPGGSLRLSCAASGFTFSAYSMIWVRQAPGKGLEWVSYIRPSGGRTTYADSVKGRFTISRDNSKNILYLQMNSLRAEDTAVYYCARGGLLLSFRELKSNYFDYWGQGTLVTVSSASTKGPSVFPLAPSSKS

SEQ ID NO: 449 - protein, 108 aa, Artificial Sequence; identical to SEQ ID NO: 322
  Description of Artificial Sequence: Synthetic polypeptide

SEQ ID NO: 450 - protein, 143 aa, Artificial Sequence
  Description of Artificial Sequence: Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLTFRELKSNYFDYWGQGTLVTVSSASTKGPSVFPLAPSSKS

SEQ ID NO: 451 - protein, 108 aa, Artificial Sequence; identical to SEQ ID NO: 322
  Description of Artificial Sequence: Synthetic polypeptide

SEQ ID NO: 452 - protein, 143 aa, Artificial Sequence
  Description of Artificial Sequence: Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLVFRELKSNYFDYWGQGTLVTVSSASTKGPSVFPLAPSSKS

SEQ ID NO: 453 - protein, 108 aa, Artificial Sequence; identical to SEQ ID NO: 322
  Description of Artificial Sequence: Synthetic polypeptide

SEQ ID NO: 454 - protein, 143 aa, Artificial Sequence; identical to SEQ ID NO: 353
  Description of Artificial Sequence: Synthetic polypeptide

SEQ ID NO: 455 - protein, 108 aa, Artificial Sequence; identical to SEQ ID NO: 322
  Description of Artificial Sequence: Synthetic polypeptide

SEQ ID NO: 456 - protein, 143 aa, Artificial Sequence
  Description of Artificial Sequence: Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWCRELKSNYFDYWGQGTLVTVSSASTKGPSVFPLAPSSKS

SEQ ID NO: 457 - protein, 108 aa, Artificial Sequence; identical to SEQ ID NO: 322
  Description of Artificial Sequence: Synthetic polypeptide

SEQ ID NO: 458 - protein, 143 aa, Artificial Sequence; identical to SEQ ID NO: 347
  Description of Artificial Sequence: Synthetic polypeptide

SEQ ID NO: 459 - protein, 108 aa, Artificial Sequence; identical to SEQ ID NO: 322
  Description of Artificial Sequence: Synthetic polypeptide

SEQ ID NO: 460 - protein, 143 aa, Artificial Sequence; identical to SEQ ID NO: 355
  Description of Artificial Sequence: Synthetic polypeptide

SEQ ID NO: 461 - protein, 108 aa, Artificial Sequence; identical to SEQ ID NO: 322
  Description of Artificial Sequence: Synthetic polypeptide

SEQ ID NO: 462 - protein, 143 aa, Artificial Sequence
  Description of Artificial Sequence: Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWFAELKSNYFDYWGQGTLVTVSSASTKGPSVFPLAPSSKS

SEQ ID NO: 463 - protein, 108 aa, Artificial Sequence; identical to SEQ ID NO: 322
  Description of Artificial Sequence: Synthetic polypeptide

SEQ ID NO: 464 - protein, 143 aa, Artificial Sequence
  Description of Artificial Sequence: Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWFCELKSNYFDYWGQGTLVTVSSASTKGPSVFPLAPSSKS

SEQ ID NO: 465 - protein, 108 aa, Artificial Sequence; identical to SEQ ID NO: 322
  Description of Artificial Sequence: Synthetic polypeptide

SEQ ID NO: 466 - protein, 143 aa, Artificial Sequence
  Description of Artificial Sequence: Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWFEELKSNYFDYWGQGTLVTVSSASTKGPSVFPLAPSSKS

SEQ ID NO: 467 - protein, 108 aa, Artificial Sequence; identical to SEQ ID NO: 322
  Description of Artificial Sequence: Synthetic polypeptide

SEQ ID NO: 468 - protein, 143 aa, Artificial Sequence
  Description of Artificial Sequence: Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWFFELKSNYFDYWGQGTLVTVSSASTKGPSVFPLAPSSKS

SEQ ID NO: 469 - protein, 108 aa, Artificial Sequence; identical to SEQ ID NO: 322
  Description of Artificial Sequence: Synthetic polypeptide

SEQ ID NO: 470 - protein, 143 aa, Artificial Sequence
  Description of Artificial Sequence: Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMHSLRAEDTAVYYCARGGLLLWFGELKSNYFDYWGQGTLVTVSSASTKGPSVFPLAPSSKS

SEQ ID NO: 471 - protein, 108 aa, Artificial Sequence; identical to SEQ ID NO: 322
  Description of Artificial Sequence: Synthetic polypeptide

SEQ ID NO: 472 - protein, 143 aa, Artificial Sequence
  Description of Artificial Sequence: Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWFHELKSNYFDYWGQGTLVTVSSASTKGPSVFPLAPSSKS

SEQ ID NO: 473 - protein, 108 aa, Artificial Sequence; identical to SEQ ID NO: 322
  Description of Artificial Sequence: Synthetic polypeptide

SEQ ID NO: 474 - protein, 143 aa, Artificial Sequence
  Description of Artificial Sequence: Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWFKELKSNYFDYWGQGTLVTVSSASTKGPSVFPLAPSSKS

SEQ ID NO: 475 - protein, 108 aa, Artificial Sequence; identical to SEQ ID NO: 322
  Description of Artificial Sequence: Synthetic polypeptide

SEQ ID NO: 476 - protein, 143 aa, Artificial Sequence
  Description of Artificial Sequence: Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWFLELKSNYFDYWGQGTLVTVSSASTKGPSVFPLAPSSKS

SEQ ID NO: 477 - protein, 108 aa, Artificial Sequence; identical to SEQ ID NO: 322
  Description of Artificial Sequence: Synthetic polypeptide

SEQ ID NO: 478 - protein, 143 aa, Artificial Sequence
  Description of Artificial Sequence: Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWFMELKSNYFDYWGQGTLVTVSSASTKGPSVFPLAPSSKS

SEQ ID NO: 479 - protein, 108 aa, Artificial Sequence; identical to SEQ ID NO: 322
  Description of Artificial Sequence: Synthetic polypeptide

SEQ ID NO: 480 - protein, 143 aa, Artificial Sequence
  Description of Artificial Sequence: Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWFPELKSNYFDYWGQGTLVTVSSASTKGPSVFPLAPSSKS

SEQ ID NO: 481 - protein, 108 aa, Artificial Sequence; identical to SEQ ID NO: 322
  Description of Artificial Sequence: Synthetic polypeptide

SEQ ID NO: 482 - protein, 143 aa, Artificial Sequence
  Description of Artificial Sequence: Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWFQELKSNYFDYWGQGTLVTVSSASTKGPSVFPLAPSSKS

SEQ ID NO: 483 - protein, 108 aa, Artificial Sequence; identical to SEQ ID NO: 322
  Description of Artificial Sequence: Synthetic polypeptide

SEQ ID NO: 484 - protein, 143 aa, Artificial Sequence
  Description of Artificial Sequence: Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWFRALKSNYFDYWGQGTLVTVSSASTKGPSVFPLAPSSKS

SEQ ID NO: 485 - protein, 108 aa, Artificial Sequence; identical to SEQ ID NO: 322
  Description of Artificial Sequence: Synthetic polypeptide

SEQ ID NO: 486 - protein, 143 aa, Artificial Sequence
  Description of Artificial Sequence: Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWFRCLKSNYFDYWGQGTLVTVSSASTKGPSVFPLAPSSKS

SEQ ID NO: 487 - protein, 108 aa, Artificial Sequence; identical to SEQ ID NO: 322
  Description of Artificial Sequence: Synthetic polypeptide

SEQ ID NO: 488 - protein, 143 aa, Artificial Sequence; identical to SEQ ID NO: 323
  Description of Artificial Sequence: Synthetic polypeptide

SEQ ID NO: 489 - protein, 108 aa, Artificial Sequence; identical to SEQ ID NO: 322
  Description of Artificial Sequence: Synthetic polypeptide

SEQ ID NO: 490 - protein, 143 aa, Artificial Sequence
  Description of Artificial Sequence: Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWFRGLKSNYFDYWGQGTLVTVSSASTKGPSVFPLAPSSKS

SEQ ID NO: 491 - protein, 108 aa, Artificial Sequence; identical to SEQ ID NO: 322
  Description of Artificial Sequence: Synthetic polypeptide

SEQ ID NO: 492 - protein, 143 aa, Artificial Sequence
  Description of Artificial Sequence: Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWFRHLKSNYFDYWGQGTLVTVSSASTKGPSVFPLAPSSKS

SEQ ID NO: 493 - protein, 108 aa, Artificial Sequence; identical to SEQ ID NO: 322
  Description of Artificial Sequence: Synthetic polypeptide

SEQ ID NO: 494 - protein, 143 aa, Artificial Sequence
  Description of Artificial Sequence: Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWFRKLKSNYFDYWGQGTLVTVSSASTKGPSVFPLAPSSKS

SEQ ID NO: 495 - protein, 108 aa, Artificial Sequence; identical to SEQ ID NO: 322
  Description of Artificial Sequence: Synthetic polypeptide

SEQ ID NO: 496 - protein, 143 aa, Artificial Sequence
  Description of Artificial Sequence: Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWFRLLKSNYFDYWGQGTLVTVSSASTKGPSVFPLAPSSKS

SEQ ID NO: 497 - protein, 108 aa, Artificial Sequence; identical to SEQ ID NO: 322
  Description of Artificial Sequence: Synthetic polypeptide

SEQ ID NO: 498 - protein, 143 aa, Artificial Sequence
  Description of Artificial Sequence: Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWFRNLKSNYFDYWGQGTLVTVSSASTKGPSVFPLAPSSKS

SEQ ID NO: 499 - protein, 108 aa, Artificial Sequence; identical to SEQ ID NO: 322
  Description of Artificial Sequence: Synthetic polypeptide

SEQ ID NO: 500 - protein, 143 aa, Artificial Sequence
  Description of Artificial Sequence: Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWFRPLKSNYFDYWGQGTLVTVSSASTKGPSVFPLAPSSKS

SEQ ID NO: 501 - protein, 108 aa, Artificial Sequence; identical to SEQ ID NO: 322
  Description of Artificial Sequence: Synthetic polypeptide

SEQ ID NO: 502 - protein, 143 aa, Artificial Sequence
  Description of Artificial Sequence: Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWFRQLKSNYFDYWGQGTLVTVSSASTKGPSVFPLAPSSKS

SEQ ID NO: 503 - protein, 108 aa, Artificial Sequence; identical to SEQ ID NO: 322
  Description of Artificial Sequence: Synthetic polypeptide

SEQ ID NO: 504 - protein, 143 aa, Artificial Sequence
  Description of Artificial Sequence: Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWFRRLKSNYFDYWGQGTLVTVSSASTKGPSVFPLAPSSKS

SEQ ID NO: 505 - protein, 108 aa, Artificial Sequence; identical to SEQ ID NO: 322
  Description of Artificial Sequence: Synthetic polypeptide

SEQ ID NO: 506 - protein, 143 aa, Artificial Sequence
  Description of Artificial Sequence: Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWFRSLKSNYFDYWGQGTLVTVSSASTKGPSVFPLAPSSKS

SEQ ID NO: 507 - protein, 108 aa, Artificial Sequence; identical to SEQ ID NO: 322
  Description of Artificial Sequence: Synthetic polypeptide

SEQ ID NO: 508 - protein, 143 aa, Artificial Sequence
  Description of Artificial Sequence: Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWFRTLKSNYFDYWGQGTLVTVSSASTKGPSVFPLAPSSKS

SEQ ID NO: 509 - protein, 108 aa, Artificial Sequence; identical to SEQ ID NO: 322
  Description of Artificial Sequence: Synthetic polypeptide

SEQ ID NO: 510 - protein, 143 aa, Artificial Sequence
  Description of Artificial Sequence: Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWFRVLKSNYFDYWGQGTLVTVSSASTKGPSVFPLAPSSKS

SEQ ID NO: 511 - protein, 108 aa, Artificial Sequence; identical to SEQ ID NO: 322
  Description of Artificial Sequence: Synthetic polypeptide

SEQ ID NO: 512 - protein, 143 aa, Artificial Sequence
  Description of Artificial Sequence: Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWFRWLKSNYFDYWGQGTLVTVSSASTKGPSVFPLAPSSKS

SEQ ID NO: 513 - protein, 108 aa, Artificial Sequence; identical to SEQ ID NO: 322
  Description of Artificial Sequence: Synthetic polypeptide

SEQ ID NO: 514 - protein, 143 aa, Artificial Sequence
  Description of Artificial Sequence: Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWFRYLKSNYFDYWGQGTLVTVSSASTKGPSVFPLAPSSKS

SEQ ID NO: 515 - protein, 108 aa, Artificial Sequence; identical to SEQ ID NO: 322
  Description of Artificial Sequence: Synthetic polypeptide

SEQ ID NO: 516 - protein, 143 aa, Artificial Sequence
  Description of Artificial Sequence: Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWFSELKSNYFDYWGQGTLVTVSSASTKGPSVFPLAPSSKS

SEQ ID NO: 517 - protein, 108 aa, Artificial Sequence; identical to SEQ ID NO: 322
  Description of Artificial Sequence: Synthetic polypeptide

SEQ ID NO: 518 - protein, 143 aa, Artificial Sequence
  Description of Artificial Sequence: Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWFTELKSNYFDYWGQGTLVTVSSASTKGPSVFPLAPSSKS

SEQ ID NO: 519 - protein, 108 aa, Artificial Sequence; identical to SEQ ID NO: 322
  Description of Artificial Sequence: Synthetic polypeptide

SEQ ID NO: 520 - protein, 143 aa, Artificial Sequence
  Description of Artificial Sequence: Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWFVELKSNYFDYWGQGTLVTVSSASTKGPSVFPLAPSSKS

SEQ ID NO: 521 - protein, 108 aa, Artificial Sequence; identical to SEQ ID NO: 322
  Description of Artificial Sequence: Synthetic polypeptide

SEQ ID NO: 522 - protein, 143 aa, Artificial Sequence
  Description of Artificial Sequence: Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWFWELKSNYFDYWGQGTLVTVSSASTKGPSVFPLAPSSKS

SEQ ID NO: 523 - protein, 108 aa, Artificial Sequence; identical to SEQ ID NO: 322
  Description of Artificial Sequence: Synthetic polypeptide

SEQ ID NO: 524 - protein, 143 aa, Artificial Sequence
  Description of Artificial Sequence: Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWFYELKSNYFDYWGQGTLVTVSSASTKGPSVFPLAPSSKS

SEQ ID NO: 525 - protein, 108 aa, Artificial Sequence; identical to SEQ ID NO: 322
  Description of Artificial Sequence: Synthetic polypeptide

SEQ ID NO: 526 - protein, 143 aa, Artificial Sequence; identical to SEQ ID NO: 343
  Description of Artificial Sequence: Synthetic polypeptide

SEQ ID NO: 527 - protein, 108 aa, Artificial Sequence; identical to SEQ ID NO: 322
  Description of Artificial Sequence: Synthetic polypeptide

SEQ ID NO: 528 - protein, 143 aa, Artificial Sequence
  Description of Artificial Sequence: Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWKRELKSNYFDYWGQGTLVTVSSASTKGPSVFPLAPSSKS

SEQ ID NO: 529 - protein, 108 aa, Artificial Sequence; identical to SEQ ID NO: 322
  Description of Artificial Sequence: Synthetic polypeptide

SEQ ID NO: 530 - protein, 143 aa, Artificial Sequence
  Description of Artificial Sequence: Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWLRELKSNYFDYWGQGTLVTVSSASTKGPSVFPLAPSSKS

SEQ ID NO: 531 - protein, 108 aa, Artificial Sequence; identical to SEQ ID NO: 322
  Description of Artificial Sequence: Synthetic polypeptide

SEQ ID NO: 532 - protein, 143 aa, Artificial Sequence; identical to SEQ ID NO: 341
  Description of Artificial Sequence: Synthetic polypeptide

SEQ ID NO: 533 - protein, 108 aa, Artificial Sequence; identical to SEQ ID NO: 322
  Description of Artificial Sequence: Synthetic polypeptide

SEQ ID NO: 534 - protein, 143 aa, Artificial Sequence; identical to SEQ ID NO: 345
  Description of Artificial Sequence: Synthetic polypeptide

SEQ ID NO: 535 - protein, 108 aa, Artificial Sequence; identical to SEQ ID NO: 322
  Description of Artificial Sequence: Synthetic polypeptide

SEQ ID NO: 536 - protein, 143 aa, Artificial Sequence
  Description of Artificial Sequence: Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWPRELKSNYFDYWGQGTLVTVSSASTKGPSVFPLAPSSKS

SEQ ID NO: 537 - protein, 108 aa, Artificial Sequence; identical to SEQ ID NO: 322
  Description of Artificial Sequence: Synthetic polypeptide

SEQ ID NO: 538 - protein, 143 aa, Artificial Sequence; identical to SEQ ID NO: 349
  Description of Artificial Sequence: Synthetic polypeptide

SEQ ID NO: 539 - protein, 108 aa, Artificial Sequence; identical to SEQ ID NO: 322
  Description of Artificial Sequence: Synthetic polypeptide

SEQ ID NO: 540 - protein, 143 aa, Artificial Sequence
  Description of Artificial Sequence: Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWRRELKSNYFDYWGQGTLVTVSSASTKGPSVFPLAPSSKS

SEQ ID NO: 541 - protein, 108 aa, Artificial Sequence; identical to SEQ ID NO: 322
  Description of Artificial Sequence: Synthetic polypeptide

SEQ ID NO: 542 - protein, 143 aa, Artificial Sequence; identical to SEQ ID NO: 339
  Description of Artificial Sequence: Synthetic polypeptide

SEQ ID NO: 543 - protein, 108 aa, Artificial Sequence; identical to SEQ ID NO: 322
  Description of Artificial Sequence: Synthetic polypeptide

SEQ ID NO: 544 - protein, 143 aa, Artificial Sequence; identical to SEQ ID NO: 351
  Description of Artificial Sequence: Synthetic polypeptide

SEQ ID NO: 545 - protein, 108 aa, Artificial Sequence; identical to SEQ ID NO: 322
  Description of Artificial Sequence: Synthetic polypeptide

SEQ ID NO: 546 - protein, 143 aa, Artificial Sequence
  Description of Artificial Sequence: Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWWRELKSNYFDYWGQGTLVTVSSASTKGPSVFPLAPSSKS

SEQ ID NO: 547 - protein, 108 aa, Artificial Sequence; identical to SEQ ID NO: 322
  Description of Artificial Sequence: Synthetic polypeptide

SEQ ID NO: 548 - protein, 143 aa, Artificial Sequence
  Description of Artificial Sequence: Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWYRELKSNYFDYWGQGTLVTVSSASTKGPSVFPLAPSSKS

SEQ ID NO: 549 - protein, 11 aa, Artificial Sequence
  Description of Artificial Sequence: Synthetic peptide
RASQPIDNYLN

SEQ ID NO: 550 - protein, 11 aa, Artificial Sequence
  Description of Artificial Sequence: Synthetic peptide
RASQPIDNYLN

SEQ ID NO: 551 - protein, 7 aa, Artificial Sequence
  Description of Artificial Sequence: Synthetic peptide
AASRLQS

SEQ ID NO: 552 - protein, 7 aa, Artificial Sequence
  Description of Artificial Sequence: Synthetic peptide
AASRLQS

SEQ ID NO: 553 - protein, 9 aa, Artificial Sequence
  Description of Artificial Sequence: Synthetic peptide
QQSYTVPYT

SEQ ID NO: 554 - protein, 9 aa, Artificial Sequence
  Description of Artificial Sequence: Synthetic peptide
QQSYTVPYT

SEQ ID NO: 555 - protein, 5 aa, Artificial Sequence
  Description of Artificial Sequence: Synthetic peptide
AYSMI

SEQ ID NO: 556 - protein, 5 aa, Artificial Sequence
  Description of Artificial Sequence: Synthetic peptide
AYSMI

SEQ ID NO: 557 - protein, 17 aa, Artificial Sequence
  Description of Artificial Sequence: Synthetic peptide
YIRPSGGRTTYADSVKG

SEQ ID NO: 558 - protein, 17 aa, Artificial Sequence
  Description of Artificial Sequence: Synthetic peptide
YIRPSGGRTTYADSVKG

SEQ ID NO: 559 - protein, 17 aa, Artificial Sequence
  Description of Artificial Sequence: Synthetic peptide
GGLLLWNRELKSNYFDY

SEQ ID NO: 560 - protein, 17 aa, Artificial Sequence
  Description of Artificial Sequence: Synthetic peptide
GGLLLWARELKSNYFDY

SEQ ID NO: 561 - protein, 11 aa, Artificial Sequence
  Description of Artificial Sequence: Synthetic peptide
RAGRSISTYVN

SEQ ID NO: 562 - protein, 12 aa, Artificial Sequence
  Description of Artificial Sequence: Synthetic peptide
RASQIVSSRYLA

SEQ ID NO: 563 - protein, 11 aa, Artificial Sequence
  Description of Artificial Sequence: Synthetic peptide
RASQSISNYLN

SEQ ID NO: 564 - protein, 12 aa, Artificial Sequence
  Description of Artificial Sequence: Synthetic peptide
RASQIVSSNYLA

SEQ ID NO: 565 - protein, 12 aa, Artificial Sequence
  Description of Artificial Sequence: Synthetic peptide
RTSQFVNSNYLA

SEQ ID NO: 566 - protein, 12 aa, Artificial Sequence
  Description of Artificial Sequence: Synthetic peptide
RTSQFVNSNYLA

SEQ ID NO: 567 - protein, 7 aa, Artificial Sequence
  Description of Artificial Sequence: Synthetic peptide
AASSLQS

SEQ ID NO: 568 - protein, 7 aa, Artificial Sequence
  Description of Artificial Sequence: Synthetic peptide
GAASRAT

SEQ ID NO: 569 - protein, 7 aa, Artificial Sequence
  Description of Artificial Sequence: Synthetic peptide
AASSLQS

SEQ ID NO: 570 - protein, 7 aa, Artificial Sequence
  Description of Artificial Sequence: Synthetic peptide
GASNRAT

SEQ ID NO: 571 - protein, 7 aa, Artificial Sequence
  Description of Artificial Sequence: Synthetic peptide
GASSRAT

SEQ ID NO: 572 - protein, 7 aa, Artificial Sequence
  Description of Artificial Sequence: Synthetic peptide
GASSRAT

SEQ ID NO: 573 - protein, 9 aa, Artificial Sequence
  Description of Artificial Sequence: Synthetic peptide
QQSQSTPYT

SEQ ID NO: 574 - protein, 9 aa, Artificial Sequence
  Description of Artificial Sequence: Synthetic peptide
QQTYSSPFT

SEQ ID NO: 575 - protein, 9 aa, Artificial Sequence
  Description of Artificial Sequence: Synthetic peptide
QQSYTSPYT

SEQ ID NO: 576 - protein, 9 aa, Artificial Sequence
  Description of Artificial Sequence: Synthetic peptide
QQSFNIPYT

SEQ ID NO: 577 - protein, 9 aa, Artificial Sequence
  Description of Artificial Sequence: Synthetic peptide
QQSSRTPWT

SEQ ID NO: 578 - protein, 9 aa, Artificial Sequence
  Description of Artificial Sequence: Synthetic peptide
QQSSRTPWT

SEQ ID NO: 579 - protein, 5 aa, Artificial Sequence
  Description of Artificial Sequence: Synthetic peptide
HYLMT

SEQ ID NO: 580 - protein, 5 aa, Artificial Sequence
  Description of Artificial Sequence: Synthetic peptide
HYLMT

SEQ ID NO: 581 - protein, 5 aa, Artificial Sequence
  Description of Artificial Sequence: Synthetic peptide
HYLMT

SEQ ID NO: 582 - protein, 5 aa, Artificial Sequence
  Description of Artificial Sequence: Synthetic peptide
HYLMT

SEQ ID NO: 583 - protein, 5 aa, Artificial Sequence
  Description of Artificial Sequence: Synthetic peptide
HYLMT

SEQ ID NO: 584 - protein, 5 aa, Artificial Sequence
  Description of Artificial Sequence: Synthetic peptide
HYLMT

SEQ ID NO: 585 - protein, 17 aa, Artificial Sequence
  Description of Artificial Sequence: Synthetic peptide
YISPSGGHTIYADSVKG

SEQ ID NO: 586 - protein, 17 aa, Artificial Sequence
  Description of Artificial Sequence: Synthetic peptide
YISPSGGHTIYADSVKG

SEQ ID NO: 587 - protein, 17 aa, Artificial Sequence
  Description of Artificial Sequence: Synthetic peptide
YISPSGGHTIYADSVKG

SEQ ID NO: 588 - protein, 17 aa, Artificial Sequence
  Description of Artificial Sequence: Synthetic peptide
YISPSGGHTIYADSVKG

SEQ ID NO: 589 - protein, 17 aa, Artificial Sequence
  Description of Artificial Sequence: Synthetic peptide
YISPSGGHTIYADSVKG

SEQ ID NO: 590 - protein, 17 aa, Artificial Sequence
  Description of Artificial Sequence: Synthetic peptide
YISPSGGHTIYADSVKG

SEQ ID NO: 591 - protein, 16 aa, Artificial Sequence
  Description of Artificial Sequence: Synthetic peptide
VARGIAARSRTSYFDY

SEQ ID NO: 592 - protein, 16 aa, Artificial Sequence
  Description of Artificial Sequence: Synthetic peptide
VARGIAARSRTSYFDY

SEQ ID NO: 593 - protein, 16 aa, Artificial Sequence
  Description of Artificial Sequence: Synthetic peptide
VARGIAARSRTSYFDY

SEQ ID NO: 594 - protein, 16 aa, Artificial Sequence
  Description of Artificial Sequence: Synthetic peptide
VARGIAARSRTSYFDY

SEQ ID NO: 595 - protein, 16 aa, Artificial Sequence
  Description of Artificial Sequence: Synthetic peptide
VARGIAARSRTSYFDY

SEQ ID NO: 596 - protein, 16 aa, Artificial Sequence
  Description of Artificial Sequence: Synthetic peptide
VARGIAARSRTSYFDY

SEQ ID NO: 597 - protein, 108 aa, Artificial Sequence
  Description of Artificial Sequence: Synthetic polypeptide
QDIQMTQSPSSLSASVGDRVTVTCRAGRSISTYVNWYQQKPGKAPKLLIYAASSLQSGVPSRFSGSRSGTDFTLTISSLQPEDFATYYCQQSQSTPYTFGQGTKLEVK

SEQ ID NO: 598 - protein, 142 aa, Artificial Sequence; identical to SEQ ID NO: 333
  Description of Artificial Sequence: Synthetic polypeptide

SEQ ID NO: 599 - protein, 109 aa, Artificial Sequence
  Description of Artificial Sequence: Synthetic polypeptide
QDIQMTQSPGTLSLSPGERATLSCRASQIVSSRYLAWYQQRPGQAPRLLIYGAASRATGIPDRFSGSGSGTDFTLTISSLQAEDFATYYCQQTYSSPFTFGQGTKMEIK

SEQ ID NO: 600 - protein, 142 aa, Artificial Sequence; identical to SEQ ID NO: 333
  Description of Artificial Sequence: Synthetic polypeptide

SEQ ID NO: 601 - protein, 109 aa, Artificial Sequence
  Description of Artificial Sequence: Synthetic polypeptide
QDIQMTQSPGTLSLSPGERATLSCRTSQFVNSNYLAWYQQTPGQAPRLLIYGASSRATGIPDRFSGTGYGTDFTLTISRLEPEDYGTYYCQQSSRTPWTFGQGTRVEIK

SEQ ID NO: 602 - protein, 142 aa, Artificial Sequence; identical to SEQ ID NO: 333
  Description of Artificial Sequence: Synthetic polypeptide

SEQ ID NO: 603 - protein, 110 aa, Artificial Sequence
  Description of Artificial Sequence: Synthetic polypeptide
QDIQMTQSPDSLSASVGDRVTITCRASQSISNYLNWYQQKPGKAPKLLIYAASSLQSGVPSRFSGSGSGTDFTLTISGLQPEDFASYYCQQSYTSPYTFVQGTKLEIKRT

SEQ ID NO: 604 - protein, 142 aa, Artificial Sequence; identical to SEQ ID NO: 333
  Description of Artificial Sequence: Synthetic polypeptide

SEQ ID NO: 605 - protein, 109 aa, Artificial Sequence
  Description of Artificial Sequence: Synthetic polypeptide
QDIQMTQSPATLSLSPGERATLSCRASQIVSSNYLAWYQQKPGQAPRLLIYGASNRATGIPDRFSGSGSGTEFTLTISSLQSEDFAIYYCQQSFNIPYTFGQGTRVDIK

SEQ ID NO: 606 - protein, 142 aa, Artificial Sequence; identical to SEQ ID NO: 333
  Description of Artificial Sequence: Synthetic polypeptide

SEQ ID NO: 607 - protein, 11 aa, Artificial Sequence
  Description of Artificial Sequence: Synthetic peptide
RASQSISSWLA

SEQ ID NO: 608 - protein, 11 aa, Artificial Sequence
  Description of Artificial Sequence: Synthetic peptide
RASQSISSWLA

SEQ ID NO: 609 - protein, 11 aa, Artificial Sequence
  Description of Artificial Sequence: Synthetic peptide
RASQSISSWLA

SEQ ID NO: 610 - protein, 11 aa, Artificial Sequence
  Description of Artificial Sequence: Synthetic peptide
RASQSISSWLA

SEQ ID NO: 611 - protein, 11 aa, Artificial Sequence
  Description of Artificial Sequence: Synthetic peptide
RASQSISSWLA

SEQ ID NO: 612 - protein, 11 aa, Artificial Sequence
  Description of Artificial Sequence: Synthetic peptide
RASQSISSWLA

SEQ ID NO: 613 - protein, 11 aa, Artificial Sequence
  Description of Artificial Sequence: Synthetic peptide
RASQSISSWLA

SEQ ID NO: 614 - protein, 11 aa, Artificial Sequence
  Description of Artificial Sequence: Synthetic peptide
RASQSISSWLA

SEQ ID NO: 615 - protein, 11 aa, Artificial Sequence
  Description of Artificial Sequence: Synthetic peptide
RASQSISSWLA

SEQ ID NO: 616 - protein, 11 aa, Artificial Sequence
  Description of Artificial Sequence: Synthetic peptide
RASQSISSWLA

SEQ ID NO: 617 - protein, 11 aa, Artificial Sequence
  Description of Artificial Sequence: Synthetic peptide
RASQSISSWLA

SEQ ID NO: 618 - protein, 11 aa, Artificial Sequence
  Description of Artificial Sequence: Synthetic peptide
RASQSISSWLA

SEQ ID NO: 619 - protein, 11 aa, Artificial Sequence
  Description of Artificial Sequence: Synthetic peptide
RASQSISSWLA

SEQ ID NO: 620 - protein, 11 aa, Artificial Sequence
  Description of Artificial Sequence: Synthetic peptide
RASQSISSWLA

SEQ ID NO: 621 - protein, 11 aa, Artificial Sequence
  Description of Artificial Sequence: Synthetic peptide
RASQSISSWLA

SEQ ID NO: 622 - protein, 11 aa, Artificial Sequence
  Description of Artificial Sequence: Synthetic peptide
RASQSISSWLA

SEQ ID NO: 623 - protein, 11 aa, Artificial Sequence
  Description of Artificial Sequence: Synthetic peptide
RASQSISSWLA

SEQ ID NO: 624 - protein, 11 aa, Artificial Sequence
  Description of Artificial Sequence: Synthetic peptide
RASQSISSWLA

SEQ ID NO: 625 - protein, 11 aa, Artificial Sequence
  Description of Artificial Sequence: Synthetic peptide
RASQSISSWLA

SEQ ID NO: 626 - protein, 11 aa, Artificial Sequence
  Description of Artificial Sequence: Synthetic peptide
RASQSISSWLA

SEQ ID NO: 627 - protein, 11 aa, Artificial Sequence
  Description of Artificial Sequence: Synthetic peptide
RASQSISSWLA

SEQ ID NO: 628 - protein, 11 aa, Artificial Sequence
  Description of Artificial Sequence: Synthetic peptide
RASQSISSWLA

SEQ ID NO: 629 - protein, 11 aa, Artificial Sequence
  Description of Artificial Sequence: Synthetic peptide
RASQSISSWLA

SEQ ID NO: 630 - protein, 11 aa, Artificial Sequence
  Description of Artificial Sequence: Synthetic peptide
RASQSISSWLA

SEQ ID NO: 631 - protein, 11 aa, Artificial Sequence
  Description of Artificial Sequence: Synthetic peptide
RASQSISSWLA

SEQ ID NO: 632 - protein, 11 aa, Artificial Sequence
  Description of Artificial Sequence: Synthetic peptide
RASQSISSWLA

SEQ ID NO: 633 - protein, 11 aa, Artificial Sequence
  Description of Artificial Sequence: Synthetic peptide
RASQSISSWLA

SEQ ID NO: 634 - protein, 11 aa, Artificial Sequence
  Description of Artificial Sequence: Synthetic peptide
RASQSISSWLA

SEQ ID NO: 635 - protein, 11 aa, Artificial Sequence
  Description of Artificial Sequence: Synthetic peptide
RASQSISSWLA

SEQ ID NO: 636 - protein, 11 aa, Artificial Sequence
  Description of Artificial Sequence: Synthetic peptide
RASQSISSWLA

SEQ ID NO: 637 - protein, 11 aa, Artificial Sequence
  Description of Artificial Sequence: Synthetic peptide
RASQSISSWLA

SEQ ID NO: 638 - protein, 11 aa, Artificial Sequence
  Description of Artificial Sequence: Synthetic peptide
RASQSISSWLA

SEQ ID NO: 639 - protein, 11 aa, Artificial Sequence
  Description of Artificial Sequence: Synthetic peptide
RASQSISSWLA

SEQ ID NO: 640 - protein, 11 aa, Artificial Sequence
  Description of Artificial Sequence: Synthetic peptide
RASQSISSWLA

SEQ ID NO: 641 - protein, 11 aa, Artificial Sequence
  Description of Artificial Sequence: Synthetic peptide
RASQSISSWLA

SEQ ID NO: 642 - protein, 11 aa, Artificial Sequence
  Description of Artificial Sequence: Synthetic peptide
RASQSISSWLA

SEQ ID NO: 643 - protein, 11 aa, Artificial Sequence
  Description of Artificial Sequence: Synthetic peptide
RASQSISSWLA

SEQ ID NO: 644 - protein, 11 aa, Artificial Sequence
  Description of Artificial Sequence: Synthetic peptide
RASQSISSWLA

SEQ ID NO: 645 - protein, 11 aa, Artificial Sequence
  Description of Artificial Sequence: Synthetic peptide
RASQSISSWLA

SEQ ID NO: 646 - protein, 11 aa, Artificial Sequence
  Description of Artificial Sequence: Synthetic peptide
RASQSISSWLA

SEQ ID NO: 647 - protein, 11 aa, Artificial Sequence
  Description of Artificial Sequence: Synthetic peptide
RASQSISSWLA

SEQ ID NO: 648 - protein, 11 aa, Artificial Sequence
  Description of Artificial Sequence: Synthetic peptide
RASQSISSWLA

SEQ ID NO: 649 - protein, 11 aa, Artificial Sequence
  Description of Artificial Sequence: Synthetic peptide
RASQSISSWLA

SEQ ID NO: 650 - protein, 11 aa, Artificial Sequence
  Description of Artificial Sequence: Synthetic peptide
RASQSISSWLA

SEQ ID NO: 651 - protein, 11 aa, Artificial Sequence
  Description of Artificial Sequence: Synthetic peptide
RASQSISSWLA

SEQ ID NO: 652 - protein, 11 aa, Artificial Sequence
  Description of Artificial Sequence: Synthetic peptide
RASQSISSWLA

SEQ ID NO: 653 - protein, 11 aa, Artificial Sequence
  Description of Artificial Sequence: Synthetic peptide
RASQSISSWLA

SEQ ID NO: 654 - protein, 11 aa, Artificial Sequence
  Description of Artificial Sequence: Synthetic peptide
RASQSISSWLA

SEQ ID NO: 655 - protein, 11 aa, Artificial Sequence
  Description of Artificial Sequence: Synthetic peptide
RASQSISSWLA

SEQ ID NO: 656 - protein, 11 aa, Artificial Sequence
  Description of Artificial Sequence: Synthetic peptide
RASQSISSWLA

SEQ ID NO: 657 - protein, 11 aa, Artificial Sequence
  Description of Artificial Sequence: Synthetic peptide
RASQSISSWLA

SEQ ID NO: 658 - protein, 11 aa, Artificial Sequence
  Description of Artificial Sequence: Synthetic peptide
RASQSISSWLA

SEQ ID NO: 659 - protein, 11 aa, Artificial Sequence
  Description of Artificial Sequence: Synthetic peptide
RASQSISSWLA

SEQ ID NO: 660 - protein, 11 aa, Artificial Sequence
  Description of Artificial Sequence: Synthetic peptide
RASQSISSWLA

SEQ ID NO: 661 - protein, 11 aa, Artificial Sequence
  Description of Artificial Sequence: Synthetic peptide
RASQSISSWLA

SEQ ID NO: 662 - protein, 11 aa, Artificial Sequence
  Description of Artificial Sequence: Synthetic peptide
RASQSISSWLA

SEQ ID NO: 663 - protein, 11 aa, Artificial Sequence
  Description of Artificial Sequence: Synthetic peptide
RASQSISSWLA

SEQ ID NO: 664 - protein, 11 aa, Artificial Sequence
  Description of Artificial Sequence: Synthetic peptide
RASQSISSWLA

SEQ ID NO: 665 - protein, 11 aa, Artificial Sequence
  Description of Artificial Sequence: Synthetic peptide
RASQSISSWLA

SEQ ID NO: 666 - protein, 11 aa, Artificial Sequence
  Description of Artificial Sequence: Synthetic peptide
RASQSISSWLA

SEQ ID NO: 667 - protein, 11 aa, Artificial Sequence
  Description of Artificial Sequence: Synthetic peptide
RASQSISSWLA

SEQ ID NO: 668 - protein, 11 aa, Artificial Sequence
  Description of Artificial Sequence: Synthetic peptide
RASQSISSWLA

SEQ ID NO: 669 - protein, 11 aa, Artificial Sequence
  Description of Artificial Sequence: Synthetic peptide
RASQSISSWLA

SEQ ID NO: 670 - protein, 11 aa, Artificial Sequence
  Description of Artificial Sequence: Synthetic peptide
RASQSISSWLA

SEQ ID NO: 671 - protein, 11 aa, Artificial Sequence
  Description of Artificial Sequence: Synthetic peptide
RASQSISSWLA

SEQ ID NO: 672 - protein, 11 aa, Artificial Sequence
  Description of Artificial Sequence: Synthetic peptide
RASQSISSWLA

SEQ ID NO: 673 - protein, 11 aa, Artificial Sequence
  Description of Artificial Sequence: Synthetic peptide
RASQSISSWLA

SEQ ID NO: 674 - protein, 11 aa, Artificial Sequence
  Description of Artificial Sequence: Synthetic peptide
RASQSISSWLA

SEQ ID NO: 675 - protein, 11 aa, Artificial Sequence
  Description of Artificial Sequence: Synthetic peptide
RASQSISSWLA

SEQ ID NO: 676 - protein, 11 aa, Artificial Sequence
  Description of Artificial Sequence: Synthetic peptide
RASQSISSWLA

SEQ ID NO: 677 - protein, 11 aa, Artificial Sequence
  Description of Artificial Sequence: Synthetic peptide
RASQSISSWLA

SEQ ID NO: 678 - protein, 11 aa, Artificial Sequence
  Description of Artificial Sequence: Synthetic peptide
RASQSISSWLA

SEQ ID NO: 679 - protein, 11 aa, Artificial Sequence
  Description of Artificial Sequence: Synthetic peptide
RASQSISSWLA

SEQ ID NO: 680 - protein, 11 aa, Artificial Sequence
  Description of Artificial Sequence: Synthetic peptide
RASQSISSWLA

SEQ ID NO: 681 - protein, 11 aa, Artificial Sequence
  Description of Artificial Sequence: Synthetic peptide
RASQSISSWLA

SEQ ID NO: 682 - protein, 11 aa, Artificial Sequence
  Description of Artificial Sequence: Synthetic peptide
RASQSISSWLA

SEQ ID NO: 683 - protein, 11 aa, Artificial Sequence
  Description of Artificial Sequence: Synthetic peptide
RASQSISSWLA

SEQ ID NO: 684 - protein, 11 aa, Artificial Sequence
  Description of Artificial Sequence: Synthetic peptide
RASQSISSWLA

SEQ ID NO: 685 - protein, 11 aa, Artificial Sequence
  Description of Artificial Sequence: Synthetic peptide
RASQSISSWLA

SEQ ID NO: 686 - protein, 11 aa, Artificial Sequence
  Description of Artificial Sequence: Synthetic peptide
RASQSISSWLA

SEQ ID NO: 687 - protein, 11 aa, Artificial Sequence
  Description of Artificial Sequence: Synthetic peptide
RASQSISSWLA

SEQ ID NO: 688 - protein, 11 aa, Artificial Sequence
  Description of Artificial Sequence: Synthetic peptide
RASQSISSWLA

SEQ ID NO: 689 - protein, 7 aa, Artificial Sequence
  Description of Artificial Sequence: Synthetic peptide
KASTLES

SEQ ID NO: 690 - protein, 7 aa, Artificial Sequence
  Description of Artificial Sequence: Synthetic peptide
KASTLES

SEQ ID NO: 691 - protein, 7 aa, Artificial Sequence
  Description of Artificial Sequence: Synthetic peptide
KASTLES

SEQ ID NO: 692 - protein, 7 aa, Artificial Sequence
  Description of Artificial Sequence: Synthetic peptide
KASTLES

SEQ ID NO: 693 - protein, 7 aa, Artificial Sequence
  Description of Artificial Sequence: Synthetic peptide
KASTLES

SEQ ID NO: 694 - protein, 7 aa, Artificial Sequence
  Description of Artificial Sequence: Synthetic peptide
KASTLES

SEQ ID NO: 695 - protein, 7 aa, Artificial Sequence
  Description of Artificial Sequence: Synthetic peptide
KASTLES

SEQ ID NO: 696 - protein, 7 aa, Artificial Sequence
  Description of Artificial Sequence: Synthetic peptide
KASTLES

SEQ ID NO: 697 - protein, 7 aa, Artificial Sequence
  Description of Artificial Sequence: Synthetic peptide
KASTLES

SEQ ID NO: 698 - protein, 7 aa, Artificial Sequence
  Description of Artificial Sequence: Synthetic peptide
KASTLES

SEQ ID NO: 699 - protein, 7 aa, Artificial Sequence
  Description of Artificial Sequence: Synthetic peptide
KASTLES

SEQ ID NO: 700 - protein, 7 aa, Artificial Sequence
  Description of Artificial Sequence: Synthetic peptide
KASTLES

SEQ ID NO: 701 - protein, 7 aa, Artificial Sequence
  Description of Artificial Sequence: Synthetic peptide
KASTLES

SEQ ID NO: 702 - protein, 7 aa, Artificial Sequence
  Description of Artificial Sequence: Synthetic peptide
KASTLES

SEQ ID NO: 703 - protein, 7 aa, Artificial Sequence
  Description of Artificial Sequence: Synthetic peptide
KASTLES

SEQ ID NO: 704 - protein, 7 aa, Artificial Sequence
  Description of Artificial Sequence: Synthetic peptide
KASTLES

SEQ ID NO: 705 - protein, 7 aa, Artificial Sequence
  Description of Artificial Sequence: Synthetic peptide
KASTLES

SEQ ID NO: 706 - protein, 7 aa, Artificial Sequence
  Description of Artificial Sequence: Synthetic peptide
KASTLES

SEQ ID NO: 707 - protein, 7 aa, Artificial Sequence
  Description of Artificial Sequence: Synthetic peptide
KASTLES

SEQ ID NO: 708 - protein, 7 aa, Artificial Sequence
  Description of Artificial Sequence: Synthetic peptide
KASTLES

SEQ ID NO: 709 - protein, 7 aa, Artificial Sequence
  Description of Artificial Sequence: Synthetic peptide
KASTLES

SEQ ID NO: 710 - protein, 7 aa, Artificial Sequence
  Description of Artificial Sequence: Synthetic peptide
KASTLES

SEQ ID NO: 711 - protein, 7 aa, Artificial Sequence
  Description of Artificial Sequence: Synthetic peptide
KASTLES

SEQ ID NO: 712 - protein, 7 aa, Artificial Sequence
  Description of Artificial Sequence: Synthetic peptide
KASTLES

SEQ ID NO: 713 - protein, 7 aa, Artificial Sequence
  Description of Artificial Sequence: Synthetic peptide
KASTLES

SEQ ID NO: 714 - protein, 7 aa, Artificial Sequence
  Description of Artificial Sequence: Synthetic peptide
KASTLES

SEQ ID NO: 715 - protein, 7 aa, Artificial Sequence
  Description of Artificial Sequence: Synthetic peptide
KASTLES

SEQ ID NO: 716 - protein, 7 aa, Artificial Sequence
  Description of Artificial Sequence: Synthetic peptide
KASTLES

SEQ ID NO: 717 - protein, 7 aa, Artificial Sequence
  Description of Artificial Sequence: Synthetic peptide
KASTLES

SEQ ID NO: 718 - protein, 7 aa, Artificial Sequence
  Description of Artificial Sequence: Synthetic peptide
KASTLES

SEQ ID NO: 719 - protein, 7 aa, Artificial Sequence
  Description of Artificial Sequence: Synthetic peptide
KASTLES

SEQ ID NO: 720 - protein, 7 aa, Artificial Sequence
  Description of Artificial Sequence: Synthetic peptide
KASTLES

SEQ ID NO: 721 - protein, 7 aa, Artificial Sequence
  Description of Artificial Sequence: Synthetic peptide
KASTLES

SEQ ID NO: 722 - protein, 7 aa, Artificial Sequence
  Description of Artificial Sequence: Synthetic peptide
KASTLES

SEQ ID NO: 723 - protein, 7 aa, Artificial Sequence
  Description of Artificial Sequence: Synthetic peptide
KASTLES

SEQ ID NO: 724 - protein, 7 aa, Artificial Sequence
  Description of Artificial Sequence: Synthetic peptide
KASTLES

SEQ ID NO: 725 - protein, 7 aa, Artificial Sequence
  Description of Artificial Sequence: Synthetic peptide
KASTLES

SEQ ID NO: 726 - protein, 7 aa, Artificial Sequence
  Description of Artificial Sequence: Synthetic peptide
KASTLES

SEQ ID NO: 727 - protein, 7 aa, Artificial Sequence
  Description of Artificial Sequence: Synthetic peptide
KASTLES

SEQ ID NO: 728 - protein, 7 aa, Artificial Sequence
  Description of Artificial Sequence: Synthetic peptide
KASTLES

SEQ ID NO: 729 - protein, 7 aa, Artificial Sequence
  Description of Artificial Sequence: Synthetic peptide
KASTLES

SEQ ID NO: 730 - protein, 7 aa, Artificial Sequence
  Description of Artificial Sequence: Synthetic peptide
KASTLES

SEQ ID NO: 731 - protein, 7 aa, Artificial Sequence
  Description of Artificial Sequence: Synthetic peptide
KASTLES

SEQ ID NO: 732 - protein, 7 aa, Artificial Sequence
  Description of Artificial Sequence: Synthetic peptide
KASTLES

SEQ ID NO: 733 - protein, 7 aa, Artificial Sequence
  Description of Artificial Sequence: Synthetic peptide
KASTLES

SEQ ID NO: 734 - protein, 7 aa, Artificial Sequence
  Description of Artificial Sequence: Synthetic peptide
KASTLES

SEQ ID NO: 735 - protein, 7 aa, Artificial Sequence
  Description of Artificial Sequence: Synthetic peptide
KASTLES

SEQ ID NO: 736 - protein, 7 aa, Artificial Sequence
  Description of Artificial Sequence: Synthetic peptide
KASTLES

SEQ ID NO: 737 - protein, 7 aa, Artificial Sequence
  Description of Artificial Sequence: Synthetic peptide
KASTLES

SEQ ID NO: 738 - protein, 7 aa, Artificial Sequence
  Description of Artificial Sequence: Synthetic peptide
KASTLES

SEQ ID NO: 739 - protein, 7 aa, Artificial Sequence
  Description of Artificial Sequence: Synthetic peptide
KASTLES

SEQ ID NO: 740 - protein, 7 aa, Artificial Sequence
  Description of Artificial Sequence: Synthetic peptide
KASTLES

SEQ ID NO: 741 - protein, 7 aa, Artificial Sequence
  Description of Artificial Sequence: Synthetic peptide
KASTLES

SEQ ID NO: 742 - protein, 7 aa, Artificial Sequence
  Description of Artificial Sequence: Synthetic peptide
KASTLES

SEQ ID NO: 743 - protein, 7 aa, Artificial Sequence
  Description of Artificial Sequence: Synthetic peptide
KASTLES

SEQ ID NO: 744 - protein, 7 aa, Artificial Sequence
  Description of Artificial Sequence: Synthetic peptide
KASTLES

SEQ ID NO: 745 - protein, 7 aa, Artificial Sequence
  Description of Artificial Sequence: Synthetic peptide
KASTLES

SEQ ID NO: 746 - protein, 7 aa, Artificial Sequence
  Description of Artificial Sequence: Synthetic peptide
KASTLES

SEQ ID NO: 747 - protein, 7 aa, Artificial Sequence
  Description of Artificial Sequence: Synthetic peptide
KASTLES

SEQ ID NO: 748 - protein, 7 aa, Artificial Sequence
  Description of Artificial Sequence: Synthetic peptide
KASTLES

SEQ ID NO: 749 - protein, 7 aa, Artificial Sequence
  Description of Artificial Sequence: Synthetic peptide
KASTLES

SEQ ID NO: 750 - protein, 7 aa, Artificial Sequence
  Description of Artificial Sequence: Synthetic peptide
KASTLES

SEQ ID NO: 751 - protein, 7 aa, Artificial Sequence
  Description of Artificial Sequence: Synthetic peptide
KASTLES

SEQ ID NO: 752 - protein, 7 aa, Artificial Sequence
  Description of Artificial Sequence: Synthetic peptide
KASTLES

SEQ ID NO: 753 - protein, 7 aa, Artificial Sequence
  Description of Artificial Sequence: Synthetic peptide
KASTLES

SEQ ID NO: 754 - protein, 7 aa, Artificial Sequence
  Description of Artificial Sequence: Synthetic peptide
KASTLES

SEQ ID NO: 755 - protein, 7 aa, Artificial Sequence
  Description of Artificial Sequence: Synthetic peptide
KASTLES

SEQ ID NO: 756 - protein, 7 aa, Artificial Sequence
  Description of Artificial Sequence: Synthetic peptide
KASTLES

SEQ ID NO: 757 - protein, 7 aa, Artificial Sequence
  Description of Artificial Sequence: Synthetic peptide
KASTLES

SEQ ID NO: 758 - protein, 7 aa, Artificial Sequence
  Description of Artificial Sequence: Synthetic peptide
KASTLES

SEQ ID NO: 759 - protein, 7 aa, Artificial Sequence
  Description of Artificial Sequence: Synthetic peptide
KASTLES

SEQ ID NO: 760 - protein, 7 aa, Artificial Sequence
  Description of Artificial Sequence: Synthetic peptide
KASTLES

SEQ ID NO: 761 - protein, 7 aa, Artificial Sequence
  Description of Artificial Sequence: Synthetic peptide
KASTLES

SEQ ID NO: 762 - protein, 7 aa, Artificial Sequence
  Description of Artificial Sequence: Synthetic peptide
KASTLES

SEQ ID NO: 763 - protein, 7 aa, Artificial Sequence
  Description of Artificial Sequence: Synthetic peptide
KASTLES

SEQ ID NO: 764 - protein, 7 aa, Artificial Sequence
  Description of Artificial Sequence: Synthetic peptide
KASTLES

SEQ ID NO: 765 - protein, 7 aa, Artificial Sequence
  Description of Artificial Sequence: Synthetic peptide
KASTLES

SEQ ID NO: 766 - protein, 7 aa, Artificial Sequence
  Description of Artificial Sequence: Synthetic peptide
KASTLES

SEQ ID NO: 767 - protein, 7 aa, Artificial Sequence
  Description of Artificial Sequence: Synthetic peptide
KASTLES

SEQ ID NO: 768 - protein, 7 aa, Artificial Sequence
  Description of Artificial Sequence: Synthetic peptide
KASTLES

SEQ ID NO: 769 - protein, 7 aa, Artificial Sequence
  Description of Artificial Sequence: Synthetic peptide
KASTLES

SEQ ID NO: 770 - protein, 7 aa, Artificial Sequence
  Description of Artificial Sequence: Synthetic peptide
KASTLES

SEQ ID NO: 771 - protein, 8 aa, Artificial Sequence
  Description of Artificial Sequence: Synthetic peptide
QQYNTYWT

SEQ ID NO: 772 - protein, 8 aa, Artificial Sequence
  Description of Artificial Sequence: Synthetic peptide
QQYNTYWT

SEQ ID NO: 773 - protein, 8 aa, Artificial Sequence
  Description of Artificial Sequence: Synthetic peptide
QQYNTYWT

SEQ ID NO: 774 - protein, 8 aa, Artificial Sequence
  Description of Artificial Sequence: Synthetic peptide
QQYNTYWT

SEQ ID NO: 775 - protein, 8 aa, Artificial Sequence
  Description of Artificial Sequence: Synthetic peptide
QQYNTYWT

SEQ ID NO: 776 - protein, 8 aa, Artificial Sequence
  Description of Artificial Sequence: Synthetic peptide
QQYNTYWT

SEQ ID NO: 777 - protein, 8 aa, Artificial Sequence
  Description of Artificial Sequence: Synthetic peptide
QQYNTYWT

SEQ ID NO: 778 - protein, 8 aa, Artificial Sequence
  Description of Artificial Sequence: Synthetic peptide
QQYNTYWT

SEQ ID NO: 779 - protein, 8 aa, Artificial Sequence
  Description of Artificial Sequence: Synthetic peptide
QQYNTYWT

SEQ ID NO: 780 - protein, 8 aa, Artificial Sequence
  Description of Artificial Sequence: Synthetic peptide
QQYNTYWT

SEQ ID NO: 781 - protein, 8 aa, Artificial Sequence
  Description of Artificial Sequence: Synthetic peptide
QQYNTYWT

SEQ ID NO: 782 - protein, 8 aa, Artificial Sequence
  Description of Artificial Sequence: Synthetic peptide
QQYNTYWT

SEQ ID NO: 783 - protein, 8 aa, Artificial Sequence
  Description of Artificial Sequence: Synthetic peptide
QQYNTYWT

SEQ ID NO: 784 - protein, 8 aa, Artificial Sequence
  Description of Artificial Sequence: Synthetic peptide
QQYNTYWT

SEQ ID NO: 785 - protein, 8 aa, Artificial Sequence
  Description of Artificial Sequence: Synthetic peptide
QQYNTYWT

SEQ ID NO: 786 - protein, 8 aa, Artificial Sequence
  Description of Artificial Sequence: Synthetic peptide
QQYNTYWT

SEQ ID NO: 787 - protein, 8 aa, Artificial Sequence
  Description of Artificial Sequence: Synthetic peptide
QQYNTYWT

SEQ ID NO: 788 - protein, 8 aa, Artificial Sequence
  Description of Artificial Sequence: Synthetic peptide
QQYNTYWT

SEQ ID NO: 789 - protein, 8 aa, Artificial Sequence
  Description of Artificial Sequence: Synthetic peptide
QQYNTYWT

SEQ ID NO: 790 - protein, 8 aa, Artificial Sequence
  Description of Artificial Sequence: Synthetic peptide
QQYNTYWT

SEQ ID NO: 791 - protein, 8 aa, Artificial Sequence
  Description of Artificial Sequence: Synthetic peptide
QQYNTYWT

SEQ ID NO: 792 - protein, 8 aa, Artificial Sequence
  Description of Artificial Sequence: Synthetic peptide
QQYNTYWT

SEQ ID NO: 793 - protein, 8 aa, Artificial Sequence
  Description of Artificial Sequence: Synthetic peptide
QQYNTYWT

SEQ ID NO: 794 - protein, 8 aa, Artificial Sequence
  Description of Artificial Sequence: Synthetic peptide
QQYNTYWT

SEQ ID NO: 795 - protein, 8 aa, Artificial Sequence
  Description of Artificial Sequence: Synthetic peptide
QQYNTYWT

SEQ ID NO: 796 - protein, 8 aa, Artificial Sequence
  Description of Artificial Sequence: Synthetic peptide
QQYNTYWT

SEQ ID NO: 797 - protein, 8 aa, Artificial Sequence
  Description of Artificial Sequence: Synthetic peptide
QQYNTYWT

SEQ ID NO: 798 - protein, 8 aa, Artificial Sequence
  Description of Artificial Sequence: Synthetic peptide
QQYNTYWT

SEQ ID NO: 799 - protein, 8 aa, Artificial Sequence
  Description of Artificial Sequence: Synthetic peptide
QQYNTYWT

SEQ ID NO: 800 - protein, 8 aa, Artificial Sequence
  Description of Artificial Sequence: Synthetic peptide
QQYNTYWT

SEQ ID NO: 801 - protein, 8 aa, Artificial Sequence
  Description of Artificial Sequence: Synthetic peptide
QQYNTYWT

SEQ ID NO: 802 - protein, 8 aa, Artificial Sequence
  Description of Artificial Sequence: Synthetic peptide
QQYNTYWT

SEQ ID NO: 803 - protein, 8 aa, Artificial Sequence
  Description of Artificial Sequence: Synthetic peptide
QQYNTYWT

SEQ ID NO: 804 - protein, 8 aa, Artificial Sequence
  Description of Artificial Sequence: Synthetic peptide
QQYNTYWT

SEQ ID NO: 805 - protein, 8 aa, Artificial Sequence
  Description of Artificial Sequence: Synthetic peptide
QQYNTYWT

SEQ ID NO: 806 - protein, 8 aa, Artificial Sequence
  Description of Artificial Sequence: Synthetic peptide
QQYNTYWT

SEQ ID NO: 807 - protein, 8 aa, Artificial Sequence
  Description of Artificial Sequence: Synthetic peptide
QQYNTYWT

SEQ ID NO: 808 - protein, 8 aa, Artificial Sequence
  Description of Artificial Sequence: Synthetic peptide
QQYNTYWT

SEQ ID NO: 809 - protein, 8 aa, Artificial Sequence
  Description of Artificial Sequence: Synthetic peptide
QQYNTYWT

SEQ ID NO: 810 - protein, 8 aa, Artificial Sequence
  Description of Artificial Sequence: Synthetic peptide
QQYNTYWT

SEQ ID NO: 811 - protein, 8 aa, Artificial Sequence
  Description of Artificial Sequence: Synthetic peptide
QQYNTYWT

SEQ ID NO: 812 - protein, 8 aa, Artificial Sequence
  Description of Artificial Sequence: Synthetic peptide
QQYNTYWT

SEQ ID NO: 813 - protein, 8 aa, Artificial Sequence
  Description of Artificial Sequence: Synthetic peptide
QQYNTYWT

SEQ ID NO: 814 - protein, 8 aa, Artificial Sequence
  Description of Artificial Sequence: Synthetic peptide
QQYNTYWT

SEQ ID NO: 815 - protein, 8 aa, Artificial Sequence
  Description of Artificial Sequence: Synthetic peptide
QQYNTYWT

SEQ ID NO: 816 - protein, 8 aa, Artificial Sequence
  Description of Artificial Sequence: Synthetic peptide
QQYNTYWT

SEQ ID NO: 817 - protein, 8 aa, Artificial Sequence
  Description of Artificial Sequence: Synthetic peptide
QQYNTYWT

SEQ ID NO: 818 - protein, 8 aa, Artificial Sequence
  Description of Artificial Sequence: Synthetic peptide
QQYNTYWT

SEQ ID NO: 819 - protein, 8 aa, Artificial Sequence
  Description of Artificial Sequence: Synthetic peptide
QQYNTYWT

SEQ ID NO: 820 - protein, 8 aa, Artificial Sequence
  Description of Artificial Sequence: Synthetic peptide
QQYNTYWT

SEQ ID NO: 821 - protein, 8 aa, Artificial Sequence
  Description of Artificial Sequence: Synthetic peptide
QQYNTYWT

SEQ ID NO: 822 - protein, 8 aa, Artificial Sequence
  Description of Artificial Sequence: Synthetic peptide
QQYNTYWT

SEQ ID NO: 823 - protein, 8 aa, Artificial Sequence
  Description of Artificial Sequence: Synthetic peptide
QQYNTYWT

SEQ ID NO: 824 - protein, 8 aa, Artificial Sequence
  Description of Artificial Sequence: Synthetic peptide
QQYNTYWT

SEQ ID NO: 825 - protein, 8 aa, Artificial Sequence
  Description of Artificial Sequence: Synthetic peptide
QQYNTYWT

SEQ ID NO: 826 - protein, 8 aa, Artificial Sequence
  Description of Artificial Sequence: Synthetic peptide
QQYNTYWT

SEQ ID NO: 827 - protein, 8 aa, Artificial Sequence
  Description of Artificial Sequence: Synthetic peptide
QQYNTYWT

SEQ ID NO: 828 - protein, 8 aa, Artificial Sequence
  Description of Artificial Sequence: Synthetic peptide
QQYNTYWT

SEQ ID NO: 829 - protein, 8 aa, Artificial Sequence
  Description of Artificial Sequence: Synthetic peptide
QQYNTYWT

SEQ ID NO: 830 - protein, 8 aa, Artificial Sequence
  Description of Artificial Sequence: Synthetic peptide
QQYNTYWT

SEQ ID NO: 831 - protein, 8 aa, Artificial Sequence
  Description of Artificial Sequence: Synthetic peptide
QQYNTYWT

SEQ ID NO: 832 - protein, 8 aa, Artificial Sequence
  Description of Artificial Sequence: Synthetic peptide
QQYNTYWT

SEQ ID NO: 833 - protein, 8 aa, Artificial Sequence
  Description of Artificial Sequence: Synthetic peptide
QQYNTYWT

SEQ ID NO: 834 - protein, 8 aa, Artificial Sequence
  Description of Artificial Sequence: Synthetic peptide
QQYNTYWT

SEQ ID NO: 835 - protein, 8 aa, Artificial Sequence
  Description of Artificial Sequence: Synthetic peptide
QQYNTYWT

SEQ ID NO: 836 - protein, 8 aa, Artificial Sequence
  Description of Artificial Sequence: Synthetic peptide
QQYNTYWT

SEQ ID NO: 837 - protein, 8 aa, Artificial Sequence
  Description of Artificial Sequence: Synthetic peptide
QQYNTYWT

SEQ ID NO: 838 - protein, 8 aa, Artificial Sequence
  Description of Artificial Sequence: Synthetic peptide
QQYNTYWT

SEQ ID NO: 839 - protein, 8 aa, Artificial Sequence
  Description of Artificial Sequence: Synthetic peptide
QQYNTYWT

SEQ ID NO: 840 - protein, 8 aa, Artificial Sequence
  Description of Artificial Sequence: Synthetic peptide
QQYNTYWT

SEQ ID NO: 841 - protein, 8 aa, Artificial Sequence
  Description of Artificial Sequence: Synthetic peptide
QQYNTYWT

SEQ ID NO: 842 - protein, 8 aa, Artificial Sequence
  Description of Artificial Sequence: Synthetic peptide
QQYNTYWT

SEQ ID NO: 843 - protein, 8 aa, Artificial Sequence
  Description of Artificial Sequence: Synthetic peptide
QQYNTYWT

SEQ ID NO: 844 - protein, 8 aa, Artificial Sequence
  Description of Artificial Sequence: Synthetic peptide
QQYNTYWT

SEQ ID NO: 845 - protein, 8 aa, Artificial Sequence
  Description of Artificial Sequence: Synthetic peptide
QQYNTYWT

SEQ ID NO: 846 - protein, 8 aa, Artificial Sequence
  Description of Artificial Sequence: Synthetic peptide
QQYNTYWT

SEQ ID NO: 847 - protein, 8 aa, Artificial Sequence
  Description of Artificial Sequence: Synthetic peptide
QQYNTYWT

SEQ ID NO: 848 - protein, 8 aa, Artificial Sequence
  Description of Artificial Sequence: Synthetic peptide
QQYNTYWT

SEQ ID NO: 849 - protein, 8 aa, Artificial Sequence
  Description of Artificial Sequence: Synthetic peptide
QQYNTYWT

SEQ ID NO: 850 - protein, 8 aa, Artificial Sequence
  Description of Artificial Sequence: Synthetic peptide
QQYNTYWT

SEQ ID NO: 851 - protein, 8 aa, Artificial Sequence
  Description of Artificial Sequence: Synthetic peptide
QQYNTYWT

SEQ ID NO: 852 - protein, 8 aa, Artificial Sequence
  Description of Artificial Sequence: Synthetic peptide
QQYNTYWT

SEQ ID NO: 853 - protein, 5 aa, Artificial Sequence
  Description of Artificial Sequence: Synthetic peptide
HYIMM

SEQ ID NO: 854 - protein, 5 aa, Artificial Sequence
  Description of Artificial Sequence: Synthetic peptide
IYSMH

SEQ ID NO: 855 - protein, 5 aa, Artificial Sequence
  Description of Artificial Sequence: Synthetic peptide
VYNMH

SEQ ID NO: 856 - protein, 5 aa, Artificial Sequence
  Description of Artificial Sequence: Synthetic peptide
HYIMM

SEQ ID NO: 857 - protein, 5 aa, Artificial Sequence
  Description of Artificial Sequence: Synthetic peptide
HYIMM

SEQ ID NO: 858 - protein, 5 aa, Artificial Sequence
  Description of Artificial Sequence: Synthetic peptide
IYSMH

SEQ ID NO: 859 - protein, 5 aa, Artificial Sequence
  Description of Artificial Sequence: Synthetic peptide
HYIMM

SEQ ID NO: 860 - protein, 5 aa, Artificial Sequence
  Description of Artificial Sequence: Synthetic peptide
HYIMM

SEQ ID NO: 861 - protein, 5 aa, Artificial Sequence
  Description of Artificial Sequence: Synthetic peptide
HYIMM

SEQ ID NO: 862 - protein, 5 aa, Artificial Sequence
  Description of Artificial Sequence: Synthetic peptide
IYDMI

SEQ ID NO: 863 - protein, 5 aa, Artificial Sequence
  Description of Artificial Sequence: Synthetic peptide
HYIMM

SEQ ID NO: 864 - protein, 5 aa, Artificial Sequence
  Description of Artificial Sequence: Synthetic peptide
VYNMH

SEQ ID NO: 865 - protein, 5 aa, Artificial Sequence
  Description of Artificial Sequence: Synthetic peptide
IYDMT

SEQ ID NO: 866 - protein, 5 aa, Artificial Sequence
  Description of Artificial Sequence: Synthetic peptide
HYIMM

SEQ ID NO: 867 - protein, 5 aa, Artificial Sequence
  Description of Artificial Sequence: Synthetic peptide
SYNMH

SEQ ID NO: 868 - protein, 5 aa, Artificial Sequence
  Description of Artificial Sequence: Synthetic peptide
RYSMR

SEQ ID NO: 869 - protein, 5 aa, Artificial Sequence
  Description of Artificial Sequence: Synthetic peptide
IYSMQ

SEQ ID NO: 870 - protein, 5 aa, Artificial Sequence
  Description of Artificial Sequence: Synthetic peptide
VYSMT

SEQ ID NO: 871 - protein, 5 aa, Artificial Sequence
  Description of Artificial Sequence: Synthetic peptide
IYDMN

SEQ ID NO: 872 - protein, 5 aa, Artificial Sequence
  Description of Artificial Sequence: Synthetic peptide
HYIMM

SEQ ID NO: 873 - protein, 6 aa, Artificial Sequence
  Description of Artificial Sequence: Synthetic peptide
HYMGMN

SEQ ID NO: 874 - protein, 5 aa, Artificial Sequence
  Description of Artificial Sequence: Synthetic peptide
TYTMR

SEQ ID NO: 875 - protein, 5 aa, Artificial Sequence
  Description of Artificial Sequence: Synthetic peptide
IYDMW

SEQ ID NO: 876 - protein, 5 aa, Artificial Sequence
  Description of Artificial Sequence: Synthetic peptide
IYNMI

SEQ ID NO: 877 - protein, 5 aa, Artificial Sequence
  Description of Artificial Sequence: Synthetic peptide
IYHMY

SEQ ID NO: 878 - protein, 5 aa, Artificial Sequence
  Description of Artificial Sequence: Synthetic peptide
TYSMY

SEQ ID NO: 879 - protein, 5 aa, Artificial Sequence
  Description of Artificial Sequence: Synthetic peptide
HYIMM

SEQ ID NO: 880 - protein, 5 aa, Artificial Sequence
  Description of Artificial Sequence: Synthetic peptide
IYDMY

SEQ ID NO: 881 - protein, 5 aa, Artificial Sequence
  Description of Artificial Sequence: Synthetic peptide
VYSMW

SEQ ID NO: 882 - protein, 5 aa, Artificial Sequence
  Description of Artificial Sequence: Synthetic peptide
HYIMM

SEQ ID NO: 883 - protein, 5 aa, Artificial Sequence
  Description of Artificial Sequence: Synthetic peptide
IYGMF

SEQ ID NO: 884 - protein, 5 aa, Artificial Sequence
  Description of Artificial Sequence: Synthetic peptide
IYSMF

SEQ ID NO: 885 - protein, 5 aa, Artificial Sequence
  Description of Artificial Sequence: Synthetic peptide
IYSMY

SEQ ID NO: 886 - protein, 5 aa, Artificial Sequence
  Description of Artificial Sequence: Synthetic peptide
RYSMI

SEQ ID NO: 887 - protein, 5 aa, Artificial Sequence
  Description of Artificial Sequence: Synthetic peptide
HYIMM

SEQ ID NO: 888 - protein, 5 aa, Artificial Sequence
  Description of Artificial Sequence: Synthetic peptide
HYIMM

SEQ ID NO: 889 - protein, 5 aa, Artificial Sequence
  Description of Artificial Sequence: Synthetic peptide
KYWMY

SEQ ID NO: 890 - protein, 5 aa, Artificial Sequence
  Description of Artificial Sequence: Synthetic peptide
RYQMH

SEQ ID NO: 891 - protein, 5 aa, Artificial Sequence
  Description of Artificial Sequence: Synthetic peptide
PYNMY

SEQ ID NO: 892 - protein, 5 aa, Artificial Sequence
  Description of Artificial Sequence: Synthetic peptide
HYIMM

SEQ ID NO: 893 - protein, 5 aa, Artificial Sequence
  Description of Artificial Sequence: Synthetic peptide
HYIMM

SEQ ID NO: 894 - protein, 5 aa, Artificial Sequence
  Description of Artificial Sequence: Synthetic peptide
HYIMM

SEQ ID NO: 895 - protein, 5 aa, Artificial Sequence
  Description of Artificial Sequence: Synthetic peptide
MYQMF

SEQ ID NO: 896 - protein, 5 aa, Artificial Sequence
  Description of Artificial Sequence: Synthetic peptide
HYIMM

SEQ ID NO: 897 - protein, 5 aa, Artificial Sequence
  Description of Artificial Sequence: Synthetic peptide
RYKMY

SEQ ID NO: 898 - protein, 5 aa, Artificial Sequence
  Description of Artificial Sequence: Synthetic peptide
RYVMW

SEQ ID NO: 899 - protein, 5 aa, Artificial Sequence
  Description of Artificial Sequence: Synthetic peptide
HYIMM

SEQ ID NO: 900 - protein, 5 aa, Artificial Sequence
  Description of Artificial Sequence: Synthetic peptide
HYIMM

SEQ ID NO: 901 - protein, 5 aa, Artificial Sequence
  Description of Artificial Sequence: Synthetic peptide
HYIMM

SEQ ID NO: 902 - protein, 5 aa, Artificial Sequence
  Description of Artificial Sequence: Synthetic peptide
KYSMA

SEQ ID NO: 903 - protein, 5 aa, Artificial Sequence
  Description of Artificial Sequence: Synthetic peptide
IYFMS

SEQ ID NO: 904 - protein, 5 aa, Artificial Sequence
  Description of Artificial Sequence: Synthetic peptide
QYFMH

SEQ ID NO: 905 - protein, 5 aa, Artificial Sequence
  Description of Artificial Sequence: Synthetic peptide
IYTMY

SEQ ID NO: 906 - protein, 5 aa, Artificial Sequence
  Description of Artificial Sequence: Synthetic peptide
PYLMW

SEQ ID NO: 907 - protein, 5 aa, Artificial Sequence
  Description of Artificial Sequence: Synthetic peptide
IYTMM

SEQ ID NO: 908 - protein, 5 aa, Artificial Sequence
  Description of Artificial Sequence: Synthetic peptide
HYIMM

SEQ ID NO: 909 - protein, 5 aa, Artificial Sequence
  Description of Artificial Sequence: Synthetic peptide
HYIMM

SEQ ID NO: 910 - protein, 5 aa, Artificial Sequence
  Description of Artificial Sequence: Synthetic peptide
RYSMS

SEQ ID NO: 911 - protein, 5 aa, Artificial Sequence
  Description of Artificial Sequence: Synthetic peptide
WYMMQ

SEQ ID NO: 912 - protein, 5 aa, Artificial Sequence
  Description of Artificial Sequence: Synthetic peptide
QYMMM

SEQ ID NO: 913 - protein, 5 aa, Artificial Sequence
  Description of Artificial Sequence: Synthetic peptide
VYAMR

SEQ ID NO: 914 - protein, 5 aa, Artificial Sequence
  Description of Artificial Sequence: Synthetic peptide
PYNMM

SEQ ID NO: 915 - protein, 5 aa, Artificial Sequence
  Description of Artificial Sequence: Synthetic peptide
VYSMH

SEQ ID NO: 916 - protein, 5 aa, Artificial Sequence
  Description of Artificial Sequence: Synthetic peptide
HYIMM

SEQ ID NO: 917 - protein, 5 aa, Artificial Sequence
  Description of Artificial Sequence: Synthetic peptide
HYIMM

SEQ ID NO: 918 - protein, 5 aa, Artificial Sequence
  Description of Artificial Sequence: Synthetic peptide
LYVMY

SEQ ID NO: 919 - protein, 5 aa, Artificial Sequence
  Description of Artificial Sequence: Synthetic peptide
PYDML

SEQ ID NO: 920 - protein, 5 aa, Artificial Sequence
  Description of Artificial Sequence: Synthetic peptide
QYTMV

SEQ ID NO: 921 - protein, 5 aa, Artificial Sequence
  Description of Artificial Sequence: Synthetic peptide
HYIMM

SEQ ID NO: 922 - protein, 5 aa, Artificial Sequence
  Description of Artificial Sequence: Synthetic peptide
HYIMM

SEQ ID NO: 923 - protein, 5 aa, Artificial Sequence
  Description of Artificial Sequence: Synthetic peptide
PYMMM

SEQ ID NO: 924 - protein, 5 aa, Artificial Sequence
  Description of Artificial Sequence: Synthetic peptide
HYIMM

SEQ ID NO: 925 - protein, 5 aa, Artificial Sequence
  Description of Artificial Sequence: Synthetic peptide
NYSMD

SEQ ID NO: 926 - protein, 5 aa, Artificial Sequence
  Description of Artificial Sequence: Synthetic peptide
HYVMM

SEQ ID NO: 927 - protein, 5 aa, Artificial Sequence
  Description of Artificial Sequence: Synthetic peptide
HYIMM

SEQ ID NO: 928 - protein, 5 aa, Artificial Sequence
  Description of Artificial Sequence: Synthetic peptide
IYLMI

SEQ ID NO: 929 - protein, 5 aa, Artificial Sequence
  Description of Artificial Sequence: Synthetic peptide
YYIMF

SEQ ID NO: 930 - protein, 5 aa, Artificial Sequence
  Description of Artificial Sequence: Synthetic peptide
HYIMM

SEQ ID NO: 931 - protein, 5 aa, Artificial Sequence
  Description of Artificial Sequence: Synthetic peptide
HYIMM

SEQ ID NO: 932 - protein, 5 aa, Artificial Sequence
  Description of Artificial Sequence: Synthetic peptide
TYAMV

SEQ ID NO: 933 - protein, 5 aa, Artificial Sequence
  Description of Artificial Sequence: Synthetic peptide
HYIMM

SEQ ID NO: 934 - protein, 5 aa, Artificial Sequence
  Description of Artificial Sequence: Synthetic peptide
PYTMI

SEQ ID NO: 935 - protein, 17 aa, Artificial Sequence
  Description of Artificial Sequence: Synthetic peptide
GIYSSGGITVYADSVKG

SEQ ID NO: 936 - protein, 17 aa, Artificial Sequence
  Description of Artificial Sequence: Synthetic peptide
SIYPSRGMTWYADSVKG

SEQ ID NO: 937 - protein, 17 aa, Artificial Sequence
  Description of Artificial Sequence: Synthetic peptide
SIYPSGGMTYYADSVKG

SEQ ID NO: 938 - protein, 17 aa, Artificial Sequence
  Description of Artificial Sequence: Synthetic peptide
GIYSSGGITVYADSVKG

SEQ ID NO: 939 - protein, 17 aa, Artificial Sequence
  Description of Artificial Sequence: Synthetic peptide
GIYSSGGITVYADSVKG

SEQ ID NO: 940 - protein, 17 aa, Artificial Sequence
  Description of Artificial Sequence: Synthetic peptide
SIYSSGGPTKYADSVKG

SEQ ID NO: 941 - protein, 17 aa, Artificial Sequence
  Description of Artificial Sequence: Synthetic peptide
GIYSSGGITVYADSVKG

SEQ ID NO: 942 - protein, 17 aa, Artificial Sequence
  Description of Artificial Sequence: Synthetic peptide
GIYSSGGITVYADSVKG

SEQ ID NO: 943 - protein, 17 aa, Artificial Sequence
  Description of Artificial Sequence: Synthetic peptide
GIYSSGGITVYADSVKG

SEQ ID NO: 944 - protein, 17 aa, Artificial Sequence
  Description of Artificial Sequence: Synthetic peptide
SIYPSGGNTSYADSVKG

SEQ ID NO: 945 - protein, 17 aa, Artificial Sequence
  Description of Artificial Sequence: Synthetic peptide
GIYSSGGITVYADSVKG

SEQ ID NO: 946 - protein, 17 aa, Artificial Sequence
  Description of Artificial Sequence: Synthetic peptide
SIYPSGGMTTYADSVKG

SEQ ID NO: 947 - protein, 17 aa, Artificial Sequence
  Description of Artificial Sequence: Synthetic peptide
SIYPSGGQTIYADSVKG

SEQ ID NO: 948 - protein, 17 aa, Artificial Sequence
  Description of Artificial Sequence: Synthetic peptide
GIYSSGGITVYADSVKG

SEQ ID NO: 949 - protein, 17 aa, Artificial Sequence
  Description of Artificial Sequence: Synthetic peptide
SIVPSGGKTNYADSVKG

SEQ ID NO: 950 - protein, 17 aa, Artificial Sequence
  Description of Artificial Sequence: Synthetic peptide
VIYPSGGQTYYADSVKG

SEQ ID NO: 951 - protein, 17 aa, Artificial Sequence
  Description of Artificial Sequence: Synthetic peptide
SIGSSGGKTLYADSVKG

SEQ ID NO: 952 - protein, 17 aa, Artificial Sequence
  Description of Artificial Sequence: Synthetic peptide
SIGSSGGSTTYADSVKG

SEQ ID NO: 953 - protein, 17 aa, Artificial Sequence
  Description of Artificial Sequence: Synthetic peptide
SIYPSGGRTRYADSVKG

SEQ ID NO: 954 - protein, 17 aa, Artificial Sequence
  Description of Artificial Sequence: Synthetic peptide
GIYSSGGITVYADSVKG

SEQ ID NO: 955 - protein, 17 aa, Artificial Sequence
  Description of Artificial Sequence: Synthetic peptide
SIVPSGGWTQYADSVKG

SEQ ID NO: 956 - protein, 17 aa, Artificial Sequence
  Description of Artificial Sequence: Synthetic peptide
SIYPSGGKTQYADSVKG

SEQ ID NO: 957 - protein, 17 aa, Artificial Sequence
  Description of Artificial Sequence: Synthetic peptide
SIRPSGGITKYADSVKG

SEQ ID NO: 958 - protein, 17 aa, Artificial Sequence
  Description of Artificial Sequence: Synthetic peptide
SIYPSGGWTTYADSVKG

SEQ ID NO: 959 - protein, 17 aa, Artificial Sequence
  Description of Artificial Sequence: Synthetic peptide
SIGPSGGPTGYADSVKG

SEQ ID NO: 960 - protein, 17 aa, Artificial Sequence
  Description of Artificial Sequence: Synthetic peptide
SIYPSGGLTWYADSVKG

SEQ ID NO: 961 - protein, 17 aa, Artificial Sequence
  Description of Artificial Sequence: Synthetic peptide
GIYSSGGITVYADSVKG

SEQ ID NO: 962 - protein, 17 aa, Artificial Sequence
  Description of Artificial Sequence: Synthetic peptide
SIGPSGGPTAYADSVKG

SEQ ID NO: 963 - protein, 17 aa, Artificial Sequence
  Description of Artificial Sequence: Synthetic peptide
SISSSGGMTEYADSVKG

SEQ ID NO: 964 - protein, 17 aa, Artificial Sequence
  Description of Artificial Sequence: Synthetic peptide
GIYSSGGITVYADSVKG

SEQ ID NO: 965 - protein, 17 aa, Artificial Sequence
  Description of Artificial Sequence: Synthetic peptide
GIGPSGGPTKYADSVKG

SEQ ID NO: 966 - protein, 17 aa, Artificial Sequence
  Description of Artificial Sequence: Synthetic peptide
SIGPSGGVTHYADSVKG

SEQ ID NO: 967 - protein, 17 aa, Artificial Sequence
  Description of Artificial Sequence: Synthetic peptide
YIRPSGGNTKYADSVKG

SEQ ID NO: 968 - protein, 17 aa, Artificial Sequence
  Description of Artificial Sequence: Synthetic peptide
SIWSSGGATEYADSVKG

SEQ ID NO: 969 - protein, 17 aa, Artificial Sequence
  Description of Artificial Sequence: Synthetic peptide
GIYSSGGITVYADSVKG

SEQ ID NO: 970 - protein, 17 aa, Artificial Sequence
  Description of Artificial Sequence: Synthetic peptide
GIYSSGGITVYADSVKG

SEQ ID NO: 971 - protein, 17 aa, Artificial Sequence
  Description of Artificial Sequence: Synthetic peptide
YIRPSGGQTYYADSVKG

SEQ ID NO: 972 - protein, 17 aa, Artificial Sequence
  Description of Artificial Sequence: Synthetic peptide
WISPSGGITGYADSVKG

SEQ ID NO: 973 - protein, 16 aa, Artificial Sequence
  Description of Artificial Sequence: Synthetic peptide
WIVPGGVTKYADSVKG

SEQ ID NO: 974 - protein, 17 aa, Artificial Sequence
  Description of Artificial Sequence: Synthetic peptide
GIYSSGGITVYADSVKG

SEQ ID NO: 975 - protein, 17 aa, Artificial Sequence
  Description of Artificial Sequence: Synthetic peptide
GIYSSGGITVYADSVKG

SEQ ID NO: 976 - protein, 17 aa, Artificial Sequence
  Description of Artificial Sequence: Synthetic peptide
GIYSSGGITVYADSVKG

SEQ ID NO: 977 - protein, 16 aa, Artificial Sequence
  Description of Artificial Sequence: Synthetic peptide
SISPGGGTQYADSVKG

SEQ ID NO: 978 - protein, 17 aa, Artificial Sequence
  Description of Artificial Sequence: Synthetic peptide
GIYSSGGITVYADSVKG

SEQ ID NO: 979 - protein, 17 aa, Artificial Sequence
  Description of Artificial Sequence: Synthetic peptide
VIGPSGGATFYADSVKG

SEQ ID NO: 980 - protein, 16 aa, Artificial Sequence
  Description of Artificial Sequence: Synthetic peptide
SISPSGDTHYADSVKG

SEQ ID NO: 981 - protein, 17 aa, Artificial Sequence
  Description of Artificial Sequence: Synthetic peptide
GIYSSGGITVYADSVKG

SEQ ID NO: 982 - protein, 17 aa, Artificial Sequence
  Description of Artificial Sequence: Synthetic peptide
GIYSSGGITVYADSVKG

SEQ ID NO: 983 - protein, 17 aa, Artificial Sequence
  Description of Artificial Sequence: Synthetic peptide
GIYSSGGITVYADSVKG

SEQ ID NO: 984 - protein, 17 aa, Artificial Sequence
  Description of Artificial Sequence: Synthetic peptide
GIYPSGGRTLYADSVKG

SEQ ID NO: 985 - protein, 17 aa, Artificial Sequence
  Description of Artificial Sequence: Synthetic peptide
SIRSSGGPTWYADSVKG

SEQ ID NO: 986 - protein, 17 aa, Artificial Sequence
  Description of Artificial Sequence: Synthetic peptide
YIYPSGGMTEYADSVKG

SEQ ID NO: 987 - protein, 17 aa, Artificial Sequence
  Description of Artificial Sequence: Synthetic peptide
SISPSGGWTYYADSVKG

SEQ ID NO: 988 - protein, 17 aa, Artificial Sequence
  Description of Artificial Sequence: Synthetic peptide
YIGPSGGPTHYADSVKG

SEQ ID NO: 989 - protein, 17 aa, Artificial Sequence
  Description of Artificial Sequence: Synthetic peptide
SIWSSGGQTKYADSVKG

SEQ ID NO: 990 - protein, 17 aa, Artificial Sequence
  Description of Artificial Sequence: Synthetic peptide
GIYSSGGITVYADSVKG

SEQ ID NO: 991 - protein, 17 aa, Artificial Sequence
  Description of Artificial Sequence: Synthetic peptide
GIYSSGGITVYADSVKG

SEQ ID NO: 992 - protein, 17 aa, Artificial Sequence
  Description of Artificial Sequence: Synthetic peptide
GISPSGGETSYADSVKG

SEQ ID NO: 993 - protein, 16 aa, Artificial Sequence
  Description of Artificial Sequence: Synthetic peptide
RISPSGGTTYADSVKG

SEQ ID NO: 994 - protein, 17 aa, Artificial Sequence
  Description of Artificial Sequence: Synthetic peptide
GISSSGGHTDYADSVKG

SEQ ID NO: 995 - protein, 17 aa, Artificial Sequence
  Description of Artificial Sequence: Synthetic peptide
SIYPSGGKTWYADSVKG

SEQ ID NO: 996 - protein, 17 aa, Artificial Sequence
  Description of Artificial Sequence: Synthetic peptide
SIWPSGGTTDYADSVKG

SEQ ID NO: 997 - protein, 17 aa, Artificial Sequence
  Description of Artificial Sequence: Synthetic peptide
VIGPSGGITLYADSVKG

SEQ ID NO: 998 - protein, 17 aa, Artificial Sequence
  Description of Artificial Sequence: Synthetic peptide
GIYSSGGITVYADSVKG

SEQ ID NO: 999 - protein, 17 aa, Artificial Sequence
  Description of Artificial Sequence: Synthetic peptide
GIYSSGGITVYADSVKG

SEQ ID NO: 1000 - protein, 17 aa, Artificial Sequence
  Description of Artificial Sequence: Synthetic peptide
YIVPSGGPTAYADSVKG

SEQ ID NO: 1001 - protein, 17 aa, Artificial Sequence
  Description of Artificial Sequence: Synthetic peptide
YIVSSGGLTKYADSVKG

SEQ ID NO: 1002 - protein, 15 aa, Artificial Sequence
  Description of Artificial Sequence: Synthetic peptide
WIYSSRANYADSVKG

SEQ ID NO: 1003 - protein, 17 aa, Artificial Sequence
  Description of Artificial Sequence: Synthetic peptide
GIYSSGGITVYADSVKG

SEQ ID NO: 1004 - protein, 17 aa, Artificial Sequence
  Description of Artificial Sequence: Synthetic peptide
GIYSSGGITVYADSVKG

SEQ ID NO: 1005 - protein, 17 aa, Artificial Sequence
  Description of Artificial Sequence: Synthetic peptide
GIYPSGGYTVYADSVKG

SEQ ID NO: 1006 - protein, 17 aa, Artificial Sequence
  Description of Artificial Sequence: Synthetic peptide
GIYSSGGITVYADSVKG

SEQ ID NO: 1007 - protein, 17 aa, Artificial Sequence
  Description of Artificial Sequence: Synthetic peptide
RIYSSGGGTIYADSVKG

SEQ ID NO: 1008 - protein, 17 aa, Artificial Sequence
  Description of Artificial Sequence: Synthetic peptide
YIVPSGGVTAYADSVKG

SEQ ID NO: 1009 - protein, 17 aa, Artificial Sequence
  Description of Artificial Sequence: Synthetic peptide
GIYSSGGITVYADSVKG

SEQ ID NO: 1010 - protein, 17 aa, Artificial Sequence
  Description of Artificial Sequence: Synthetic peptide
YIGPSGGPTEYADSVKG

SEQ ID NO: 1011 - protein, 17 aa, Artificial Sequence
  Description of Artificial Sequence: Synthetic peptide
YISPSGGYTHYADSVKG

SEQ ID NO: 1012 - protein, 17 aa, Artificial Sequence
  Description of Artificial Sequence: Synthetic peptide
GIYSSGGITVYADSVKG

SEQ ID NO: 1013 - protein, 17 aa, Artificial Sequence
  Description of Artificial Sequence: Synthetic peptide
GIYSSGGITVYADSVKG

SEQ ID NO: 1014 - protein, 17 aa, Artificial Sequence
  Description of Artificial Sequence: Synthetic peptide
SIYPSGGITTYADSVKG

SEQ ID NO: 1015 - protein, 17 aa, Artificial Sequence
  Description of Artificial Sequence: Synthetic peptide
GIYSSGGITVYADSVKG

SEQ ID NO: 1016 - protein, 17 aa, Artificial Sequence
  Description of Artificial Sequence: Synthetic peptide
SISSSGGMTPYADSVKG

SEQ ID NO: 1017 - protein, 13 aa, Artificial Sequence
  Description of Artificial Sequence: Synthetic peptide
QRTGVPRRDSFNI

SEQ ID NO: 1018 - protein, 13 aa, Artificial Sequence
  Description of Artificial Sequence: Synthetic peptide
RRTGIPRRDAFDI

SEQ ID NO: 1019 - protein, 13 aa, Artificial Sequence
  Description of Artificial Sequence: Synthetic peptide
RRTGIPRRDAFDI

SEQ ID NO: 1020 - protein, 13 aa, Artificial Sequence
  Description of Artificial Sequence: Synthetic peptide
RRIGVPRRDEFDI

SEQ ID NO: 1021 - protein, 13 aa, Artificial Sequence
  Description of Artificial Sequence: Synthetic peptide
RRTGVPRWDDFDI

SEQ ID NO: 1022 - protein, 13 aa, Artificial Sequence
  Description of Artificial Sequence: Synthetic peptide
RRTGIPRRDAFDI

SEQ ID NO: 1023 - protein, 13 aa, Artificial Sequence
  Description of Artificial Sequence: Synthetic peptide
RRIGVPRRDSFDM

SEQ ID NO: 1024 - protein, 13 aa, Artificial Sequence
  Description of Artificial Sequence: Synthetic peptide
RRTGVPRWDDFDI

SEQ ID NO: 1025 - protein, 13 aa, Artificial Sequence
  Description of Artificial Sequence: Synthetic peptide
RRTGVPRRDEFDI

SEQ ID NO: 1026 - protein, 13 aa, Artificial Sequence
  Description of Artificial Sequence: Synthetic peptide
RRTGIPRRDAFDI

SEQ ID NO: 1027 - protein, 13 aa, Artificial Sequence
  Description of Artificial Sequence: Synthetic peptide
RRIGVPRRDSFDI

SEQ ID NO: 1028 - protein, 13 aa, Artificial Sequence
  Description of Artificial Sequence: Synthetic peptide
RRTGIPRRDAFDI

SEQ ID NO: 1029 - protein, 13 aa, Artificial Sequence
  Description of Artificial Sequence: Synthetic peptide
RRTGIPRRDAFDI

SEQ ID NO: 1030 - protein, 13 aa, Artificial Sequence
  Description of Artificial Sequence: Synthetic peptide
RRTGVPRRDSFDI

SEQ ID NO: 1031 - protein, 13 aa, Artificial Sequence
  Description of Artificial Sequence: Synthetic peptide
RRTGIPRRDAFDI

SEQ ID NO: 1032 - protein, 13 aa, Artificial Sequence
  Description of Artificial Sequence: Synthetic peptide
RRTGIPRRDAFDI

SEQ ID NO: 1033 - protein, 13 aa, Artificial Sequence
  Description of Artificial Sequence: Synthetic peptide
RRTGIPRRDAFDI

SEQ ID NO: 1034 - protein, 13 aa, Artificial Sequence
  Description of Artificial Sequence: Synthetic peptide
RRTGIPRRDAFDI

SEQ ID NO: 1035 - protein, 13 aa, Artificial Sequence
  Description of Artificial Sequence: Synthetic peptide
RRTGIPRRDAFDI

SEQ ID NO: 1036 - protein, 13 aa, Artificial Sequence
  Description of Artificial Sequence: Synthetic peptide
RRTGVPRRDDFDI

SEQ ID NO: 1037 - protein, 13 aa, Artificial Sequence
  Description of Artificial Sequence: Synthetic peptide
RRTGIPRRDAFDI

SEQ ID NO: 1038 - protein, 13 aa, Artificial Sequence
  Description of Artificial Sequence: Synthetic peptide
RRTGIPRRDAFDI

SEQ ID NO: 1039 - protein, 13 aa, Artificial Sequence
  Description of Artificial Sequence: Synthetic peptide
RRTGIPRRDAFDI

SEQ ID NO: 1040 - protein, 13 aa, Artificial Sequence
  Description of Artificial Sequence: Synthetic peptide
RRTGIPRRDAFDI

SEQ ID NO: 1041 - protein, 13 aa, Artificial Sequence
  Description of Artificial Sequence: Synthetic peptide
RRTGIPRRDAFDI

SEQ ID NO: 1042 - protein, 13 aa, Artificial Sequence
  Description of Artificial Sequence: Synthetic peptide
RRTGIPRRDAFDI

SEQ ID NO: 1043 - protein, 13 aa, Artificial Sequence
  Description of Artificial Sequence: Synthetic peptide
RRIGVPRRDDFDI

SEQ ID NO: 1044 - protein, 13 aa, Artificial Sequence
  Description of Artificial Sequence: Synthetic peptide
RRTGIPRRDAFDI

SEQ ID NO: 1045 - protein, 13 aa, Artificial Sequence
  Description of Artificial Sequence: Synthetic peptide
RRTGIPRRDAFDI

SEQ ID NO: 1046 - protein, 13 aa, Artificial Sequence
  Description of Artificial Sequence: Synthetic peptide
RRRGVPRRDDFDI

SEQ ID NO: 1047 - protein, 13 aa, Artificial Sequence
  Description of Artificial Sequence: Synthetic peptide
RRTGIPRRDAFDI

SEQ ID NO: 1048 - protein, 13 aa, Artificial Sequence
  Description of Artificial Sequence: Synthetic peptide
RRTGIPRRDAFDI

SEQ ID NO: 1049 - protein, 13 aa, Artificial Sequence
  Description of Artificial Sequence: Synthetic peptide
RRTGIPRRDAFDI

SEQ ID NO: 1050 - protein, 13 aa, Artificial Sequence
  Description of Artificial Sequence: Synthetic peptide
RRTGIPRRDAFDI

SEQ ID NO: 1051 - protein, 13 aa, Artificial Sequence
  Description of Artificial Sequence: Synthetic peptide
RRIGVPRRDAFDI

SEQ ID NO: 1052 - protein, 13 aa, Artificial Sequence
  Description of Artificial Sequence: Synthetic peptide
RRTGVPRRDSFEI

SEQ ID NO: 1053 - protein, 13 aa, Artificial Sequence
  Description of Artificial Sequence: Synthetic peptide
RRTGIPRRDAFDI

SEQ ID NO: 1054 - protein, 13 aa, Artificial Sequence
  Description of Artificial Sequence: Synthetic peptide
RRTGIPRRDAFDI

SEQ ID NO: 1055 - protein, 13 aa, Artificial Sequence
  Description of Artificial Sequence: Synthetic peptide
RRTGIPRRDAFDI

SEQ ID NO: 1056 - protein, 13 aa, Artificial Sequence
  Description of Artificial Sequence: Synthetic peptide
RRTGVPRRNAFDN

SEQ ID NO: 1057 - protein, 13 aa, Artificial Sequence
  Description of Artificial Sequence: Synthetic peptide
RRTGVPRRDAFDI

SEQ ID NO: 1058 - protein, 13 aa, Artificial Sequence
  Description of Artificial Sequence: Synthetic peptide
RRTGVPRWDAFDI

SEQ ID NO: 1059 - protein, 13 aa, Artificial Sequence
  Description of Artificial Sequence: Synthetic peptide
RRTGIPRRDAFDI

SEQ ID NO: 1060 - protein, 13 aa, Artificial Sequence
  Description of Artificial Sequence: Synthetic peptide
RRTGVPRRDVFDI

SEQ ID NO: 1061 - protein, 13 aa, Artificial Sequence
  Description of Artificial Sequence: Synthetic peptide
RRTGIPRRDAFDI

SEQ ID NO: 1062 - protein, 13 aa, Artificial Sequence
  Description of Artificial Sequence: Synthetic peptide
RRTGIPRRDAFDI

SEQ ID NO: 1063 - protein, 13 aa, Artificial Sequence
  Description of Artificial Sequence: Synthetic peptide
RRTGVPRRDAFDN

SEQ ID NO: 1064 - protein, 13 aa, Artificial Sequence
  Description of Artificial Sequence: Synthetic peptide
RRSGVPRRDDFDI

SEQ ID NO: 1065 - protein, 13 aa, Artificial Sequence
  Description of Artificial Sequence: Synthetic peptide
RRKGIPRRDDFDI

SEQ ID NO: 1066 - protein, 13 aa, Artificial Sequence
  Description of Artificial Sequence: Synthetic peptide
RRTGIPRRDAFDI

SEQ ID NO: 1067 - protein, 13 aa, Artificial Sequence
  Description of Artificial Sequence: Synthetic peptide
RRTGIPRRDAFDI

SEQ ID NO: 1068 - protein, 13 aa, Artificial Sequence
  Description of Artificial Sequence: Synthetic peptide
RRTGIPRRDAFDI

SEQ ID NO: 1069 - protein, 13 aa, Artificial Sequence
  Description of Artificial Sequence: Synthetic peptide
RRTGIPRRDAFDI

SEQ ID NO: 1070 - protein, 13 aa, Artificial Sequence
  Description of Artificial Sequence: Synthetic peptide
RRTGIPRRDAFDI

SEQ ID NO: 1071 - protein, 13 aa, Artificial Sequence
  Description of Artificial Sequence: Synthetic peptide
RRTGIPRRDAFDI

SEQ ID NO: 1072 - protein, 13 aa, Artificial Sequence
  Description of Artificial Sequence: Synthetic peptide
RRTGVPRRDALDN

SEQ ID NO: 1073 - protein, 13 aa, Artificial Sequence
  Description of Artificial Sequence: Synthetic peptide
RRPGVPRRDAFDI

SEQ ID NO: 1074 - protein, 13 aa, Artificial Sequence
  Description of Artificial Sequence: Synthetic peptide
RRTGIPRRDAFDI

SEQ ID NO: 1075 - protein, 13 aa, Artificial Sequence
  Description of Artificial Sequence: Synthetic peptide
RRTGIPRRDAFDI

SEQ ID NO: 1076 - protein, 13 aa, Artificial Sequence
  Description of Artificial Sequence: Synthetic peptide
RRTGIPRRDAFDI

SEQ ID NO: 1077 - protein, 13 aa, Artificial Sequence
  Description of Artificial Sequence: Synthetic peptide
RRTGIPRRDAFDI

SEQ ID NO: 1078 - protein, 13 aa, Artificial Sequence
  Description of Artificial Sequence: Synthetic peptide
RRTGIPRRDAFDI

SEQ ID NO: 1079 - protein, 13 aa, Artificial Sequence
  Description of Artificial Sequence: Synthetic peptide
RRTGIPRRDAFDI

SEQ ID NO: 1080 - protein, 13 aa, Artificial Sequence
  Description of Artificial Sequence: Synthetic peptide
RRRGIPRRDAFDI

SEQ ID NO: 1081 - protein, 13 aa, Artificial Sequence
  Description of Artificial Sequence: Synthetic peptide
RRMGIPRRNAFDI

SEQ ID NO: 1082 - protein, 13 aa, Artificial Sequence
  Description of Artificial Sequence: Synthetic peptide
RRTGIPRRDAFDI

SEQ ID NO: 1083 - protein, 13 aa, Artificial Sequence
  Description of Artificial Sequence: Synthetic peptide
RRTGIPRRDAFDI

SEQ ID NO: 1084 - protein, 13 aa, Artificial Sequence
  Description of Artificial Sequence: Synthetic peptide
RRTGIPRRDAFDI

SEQ ID NO: 1085 - protein, 13 aa, Artificial Sequence
  Description of Artificial Sequence: Synthetic peptide
RRTGIPRRDAFDN

SEQ ID NO: 1086 - protein, 13 aa, Artificial Sequence
  Description of Artificial Sequence: Synthetic peptide
RRTGIPRWDAFDI

SEQ ID NO: 1087 - protein, 13 aa, Artificial Sequence
  Description of Artificial Sequence: Synthetic peptide
RRTGIPRRDAFDI

SEQ ID NO: 1088 - protein, 13 aa, Artificial Sequence
  Description of Artificial Sequence: Synthetic peptide
RRTGIPRRDAFEI

SEQ ID NO: 1089 - protein, 13 aa, Artificial Sequence
  Description of Artificial Sequence: Synthetic peptide
RRTGIPRRDAFDI

SEQ ID NO: 1090 - protein, 13 aa, Artificial Sequence
  Description of Artificial Sequence: Synthetic peptide
RRTGIPRRDAFDI

SEQ ID NO: 1091 - protein, 13 aa, Artificial Sequence
  Description of Artificial Sequence: Synthetic peptide
RRTGIPRRDAFDS

SEQ ID NO: 1092 - protein, 13 aa, Artificial Sequence
  Description of Artificial Sequence: Synthetic peptide
RRTGIPRRDAFDI

SEQ ID NO: 1093 - protein, 13 aa, Artificial Sequence
  Description of Artificial Sequence: Synthetic peptide
RRTGIPRRDAFDI

SEQ ID NO: 1094 - protein, 13 aa, Artificial Sequence
  Description of Artificial Sequence: Synthetic peptide
RRTGIPRRDVFDI

SEQ ID NO: 1095 - protein, 13 aa, Artificial Sequence
  Description of Artificial Sequence: Synthetic peptide
RRTGIPRRDSFDI

SEQ ID NO: 1096 - protein, 13 aa, Artificial Sequence
  Description of Artificial Sequence: Synthetic peptide
RRTGIPRRDAFDI

SEQ ID NO: 1097 - protein, 13 aa, Artificial Sequence
  Description of Artificial Sequence: Synthetic peptide
RRSGIPRRDAFDI

SEQ ID NO: 1098 - protein, 13 aa, Artificial Sequence
  Description of Artificial Sequence: Synthetic peptide
RRTGIPRRDAFDI

SEQ ID NO: 1099 - protein, 107 aa, Artificial Sequence; identical to SEQ ID NO: 336
  Description of Artificial Sequence: Synthetic polypeptide

SEQ ID NO: 1100 - protein, 139 aa, Artificial Sequence
  Description of Artificial Sequence: Synthetic polypeptide
EVQLLESGGGLVQPGGSLRLSCAASGFTFSQYMMMWVRQAPGKGLEWVSGISSSGGHTDYADSVKGRFTISRDNSKNTLYLQMNSLRAEDTAVYYCAYRRTGIPRRDAFDIWGQGTMVTVSSASTKGPSVFPLAPSSKS

SEQ ID NO: 1101 - protein, 107 aa, Artificial Sequence; identical to SEQ ID NO: 336
  Description of Artificial Sequence: Synthetic polypeptide

SEQ ID NO: 1102 - protein, 139 aa, Artificial Sequence
  Description of Artificial Sequence: Synthetic polypeptide
EVQLLESGGGLVQPGGSLRLSCAASGFTFSPYMMMWVRQAPGKGLEWVSGIYPSGGYTVYADSVKGRFTISRDNSKNTLYLQMNSLRAEDTAVYYCAYRRTGIPRRDAFDIWGQGTMVTVSSASTKGPSVFPLAPSSKS

SEQ ID NO: 1103 - protein, 107 aa, Artificial Sequence; identical to SEQ ID NO: 336
  Description of Artificial Sequence: Synthetic polypeptide

SEQ ID NO: 1104 - protein, 139 aa, Artificial Sequence
  Description of Artificial Sequence: Synthetic polypeptide
EVQLLESGGGLVQPGGSLRLSCAASGFTFSPYLMWWVRQAPGKGLEWVSYIGPSGGPTHYADSVKGRFTISRDNSKNTLYLQMNSLRAEDTAVYYCAYRRTGIPRRDAFDIWGQGTMVTVSSASTKGPSVFPLAPSSKS

SEQ ID NO: 1105 - protein, 107 aa, Artificial Sequence; identical to SEQ ID NO: 336
  Description of Artificial Sequence: Synthetic polypeptide

SEQ ID NO: 1106 - protein, 139 aa, Artificial Sequence
  Description of Artificial Sequence: Synthetic polypeptide
EVQLLESGGGLVQPGGSLRLSCAASGFTFSKYWMYWVRQAPGKGLEWVSYIRPSGGQTYYADSVKGRFTISRDNSKNTLYLQMNSLRAEDTAVYYCAYRRTGIPRRDAFDIWGQGTMVTVSSASTKGPSVFPLAPSSKS

SEQ ID NO: 1107 - protein, 107 aa, Artificial Sequence; identical to SEQ ID NO: 336
  Description of Artificial Sequence: Synthetic polypeptide

SEQ ID NO: 1108 - protein, 138 aa, Artificial Sequence
  Description of Artificial Sequence: Synthetic polypeptide
EVQLLESGGGLVQPGGSLRLSCAASGFTFSMYQMFWVRQAPGKGLEWVSSISPGGGTQYADSVKGRFTISRDNSKNTLYLQMNSLRAEDTAVYYCAYRRTGIPRRDAFDIWGQGTMVTVSSASTKGPSVFPLAPSSKS

SEQ ID NO: 1109 - protein, 107 aa, Artificial Sequence; identical to SEQ ID NO: 336
  Description of Artificial Sequence: Synthetic polypeptide

SEQ ID NO: 1110 - protein, 139 aa, Artificial Sequence
  Description of Artificial Sequence: Synthetic polypeptide
EVQLLESGGGLVQPGGSLRLSCAASGFTFSIYGMFWVRQAPGKGLEWVSGIGPSGGPTKYADSVKGRFTISRDNSKNTLYLQMNSLRAEDTAVYYCAYRRTGIPRRDAFDIWGQGTMVTVSSASTKGPSVFPLAPSSKS

SEQ ID NO: 1111 - protein, 107 aa, Artificial Sequence; identical to SEQ ID NO: 336
  Description of Artificial Sequence: Synthetic polypeptide

SEQ ID NO: 1112 - protein, 139 aa, Artificial Sequence
  Description of Artificial Sequence: Synthetic polypeptide
EVQLLESGGGLVQPGGSLRLSCAASGFTFSYYIMFWVRQAPGKGLEWVSYISPSGGYTHYADSVKGRFTISRDNSKNTLYLQMNSLRAEDTAVYYCAYRRTGIPRRDAFDIWGQGTMVTVSSASTKGPSVFPLAPSSKS

SEQ ID NO: 1113 - protein, 107 aa, Artificial Sequence; identical to SEQ ID NO: 336
  Description of Artificial Sequence: Synthetic polypeptide

SEQ ID NO: 1114 - protein, 139 aa, Artificial Sequence
  Description of Artificial Sequence: Synthetic polypeptide
EVQLLESGGGLVQPGGSLRLSCAASGFTFSHYVMMWVRQAPGKGLEWVSYIVPSGGVTAYADSVKGRFTISRDNSKNTLYLQMNSLRAEDTAVYYCAYRRTGIPRRDAFDIWGQGTMVTVSSASTKGPSVFPLAPSSKS

SEQ ID NO: 1115 - protein, 107 aa, Artificial Sequence; identical to SEQ ID NO: 336
  Description of Artificial Sequence: Synthetic polypeptide

SEQ ID NO: 1116 - protein, 139 aa, Artificial Sequence
  Description of Artificial Sequence: Synthetic polypeptide
EVQLLESGGGLVQPGGSLRLSCAASGFTFSPYNMMWVRQAPGKGLEWVSSIWPSGGTTDYADSVKGRFTISRDNSKNTLYLQMNSLRAEDTAVYYCAYRRTGIPRRDAFDIWGQGTMVTVSSASTKGPSVFPLAPSSKS

SEQ ID NO: 1117 - protein, 107 aa, Artificial Sequence; identical to SEQ ID NO: 336
  Description of Artificial Sequence: Synthetic polypeptide

SEQ ID NO: 1118 - protein, 139 aa, Artificial Sequence
  Description of Artificial Sequence: Synthetic polypeptide
EVQLLESGGGLVQPGGSLRLSCAASGFTFSIYSMHWVRQAPGKGLEWVSSIYPSRGMTWYADSVKGRFTISRDNSKNTLYLQMNSLRAEDTAVYYCAYRRTGIPRRDAFDIWGQGTMVTVSSASTKGPSVFPLAPSSKS

SEQ ID NO: 1119 - protein, 107 aa, Artificial Sequence; identical to SEQ ID NO: 336
  Description of Artificial Sequence: Synthetic polypeptide

SEQ ID NO: 1120 - protein, 139 aa, Artificial Sequence
  Description of Artificial Sequence: Synthetic polypeptide
EVQLLESGGGLVQPGGSLRLSCAASGFTFSVYSMHWVRQAPGKGLEWVSVIGPSGGITLYADSVKGRFTISRDNSKNTLYLQMNSLRAEDTAVYYCAYRRTGIPRRDAFDIWGQGTMVTVSSASTKGPSVFPLAPSSKS

SEQ ID NO: 1121 - protein, 107 aa, Artificial Sequence; identical to SEQ ID NO: 336
  Description of Artificial Sequence: Synthetic polypeptide

SEQ ID NO: 1122 - protein, 139 aa, Artificial Sequence
  Description of Artificial Sequence: Synthetic polypeptide
EVQLLESGGGLVQPGGSLRLSCAASGFTFSRYSMRWVRQAPGKGLEWVSVIYPSGGQTYYADSVKGRFTISRDNSKNTLYLQMNSLRAEDTAVYYCAYRRTGIPRRDAFDIWGQGTMVTVSSASTKGPSVFPLAPSSKS

SEQ ID NO: 1123 - protein, 107 aa, Artificial Sequence; identical to SEQ ID NO: 336
  Description of Artificial Sequence: Synthetic polypeptide

SEQ ID NO: 1124 - protein, 139 aa, Artificial Sequence
  Description of Artificial Sequence: Synthetic polypeptide
EVQLLESGGGLVQPGGSLRLSCAASGFTFSNYSMDWVRQAPGKGLEWVSRIYSSGGGTIYADSVKGRFTISRDNSKNTLYLQMNSLRAEDTAVYYCAYRRTGIPRRDAFDIWGQGTMVTVSSASTKGPSVFPLAPSSKS

SEQ ID NO: 1125 - protein, 107 aa, Artificial Sequence; identical to SEQ ID NO: 336
  Description of Artificial Sequence: Synthetic polypeptide

SEQ ID NO: 1126 - protein, 138 aa, Artificial Sequence
  Description of Artificial Sequence: Synthetic polypeptide
EVQLLESGGGLVQPGGSLRLSCAASGFTFSRYVMWWVRQAPGKGLEWVSSISPSGDTHYADSVKGRFTISRDNSKNTLYLQMNSLRAEDTAVYYCAYRRTGIPRRDAFDIWGQGTMVTVSSASTKGPSVFPLAPSSKS

SEQ ID NO: 1127 - protein, 107 aa, Artificial Sequence; identical to SEQ ID NO: 336
  Description of Artificial Sequence: Synthetic polypeptide

SEQ ID NO: 1128 - protein, 139 aa, Artificial Sequence
  Description of Artificial Sequence: Synthetic polypeptide
EVQLLESGGGLVQPGGSLRLSCAASGFTFSIYDMIWVRQAPGKGLEWVSSIYPSGGNTSYADSVKGRFTISRDNSKNTLYLQMNSLRAEDTAVYYCAYRRTGIPRRDAFDIWGQGTMVTVSSASTKGPSVFPLAPSSKS

SEQ ID NO: 1129 - protein, 107 aa, Artificial Sequence; identical to SEQ ID NO: 336
  Description of Artificial Sequence: Synthetic polypeptide

SEQ ID NO: 1130 - protein, 139 aa, Artificial Sequence
  Description of Artificial Sequence: Synthetic polypeptide
EVQLLESGGGLVQPGGSLRLSCAASGFTFSIYSMQWVRQAPGKGLEWVSSIGSSGGKTLYADSVKGRFTISRDNSKNTLYLQMNSLRAEDTAVYYCAYRRTGIPRRDAFDIWGQGTMVTVSSASTKGPSVFPLAPSSKS

SEQ ID NO: 1131 - protein, 107 aa, Artificial Sequence; identical to SEQ ID NO: 336
  Description of Artificial Sequence: Synthetic polypeptide

SEQ ID NO: 1132 - protein, 139 aa, Artificial Sequence
  Description of Artificial Sequence: Synthetic polypeptide
EVQLLESGGGLVQPGGSLRLSCAASGFTFSVYNMHWVRQAPGKGLEWVSSIYPSGGMTTYADSVKGRFTISRDNSKNTLYLQMNSLRAEDTAVYYCAYRRTGIPRRDAFDIWGQGTMVTVSSASTKGPSVFPLAPSSKS

SEQ ID NO: 1133 - protein, 107 aa, Artificial Sequence; identical to SEQ ID NO: 336
  Description of Artificial Sequence: Synthetic polypeptide

SEQ ID NO: 1134 - protein, 139 aa, Artificial Sequence
  Description of Artificial Sequence: Synthetic polypeptide
EVQLLESGGGLVQPGGSLRLSCAASGFTFSPYDMLWVRQAPGKGLEWVSYIVSSGGLTKYADSVKGRFTISRDNSKNTLYLQMNSLRAEDTAVYYCAYRRTGIPRRDAFDIWGQGTMVTVSSASTKGPSVFPLAPSSKS

SEQ ID NO: 1135 - protein, 107 aa, Artificial Sequence; identical to SEQ ID NO: 336
  Description of Artificial Sequence: Synthetic polypeptide

SEQ ID NO: 1136 - protein, 139 aa, Artificial Sequence
  Description of Artificial Sequence: Synthetic polypeptide
EVQLLESGGGLVQPGGSLRLSCAASGFTFSTYTMRWVRQAPGKGLEWVSSIYPSGGKTQYADSVKGRFTISRDNSKNTLYLQMNSLRAEDTAVYYCAYRRTGIPRRDAFDIWGQGTMVTVSSASTKGPSVFPLAPSSKS

SEQ ID NO: 1137 - protein, 107 aa, Artificial Sequence; identical to SEQ ID NO: 336
  Description of Artificial Sequence: Synthetic polypeptide

SEQ ID NO: 1138 - protein, 139 aa, Artificial Sequence
  Description of Artificial Sequence: Synthetic polypeptide
EVQLLESGGGLVQPGGSLRLSCAASGFTFSIYHMYWVRQAPGKGLEWVSSIGPSGGPTGYADSVKGRFTISRDNSKNTLYLQMNSLRAEDTAVYYCAYRRTGIPRRDAFDIWGQGTMVTVSSASTKGPSVFPLAPSSKS

SEQ ID NO: 1139 - protein, 107 aa, Artificial Sequence; identical to SEQ ID NO: 336
  Description of Artificial Sequence: Synthetic polypeptide

SEQ ID NO: 1140 - protein, 139 aa, Artificial Sequence
  Description of Artificial Sequence: Synthetic polypeptide
EVQLLESGGGLVQPGGSLRLSCAASGFTFSIYSMFWVRQAPGKGLEWVSSIGPSGGVTHYADSVKGRFTISRDNSKNTLYLQMNSLRAEDTAVYYCAYRRTGIPRRDAFDIWGQGTMVTVSSASTKGPSVFPLAPSSKS

SEQ ID NO: 1141 - protein, 107 aa, Artificial Sequence; identical to SEQ ID NO: 336
  Description of Artificial Sequence: Synthetic polypeptide

SEQ ID NO: 1142 - protein, 139 aa, Artificial Sequence
  Description of Artificial Sequence: Synthetic polypeptide
EVQLLESGGGLVQPGGSLRLSCAASGFTFSVYAMRWVRQAPGKGLEWVSSIYPSGGKTWYADSVKGRFTISRDNSKNTLYLQMNSLRAEDTAVYYCAYRRTGIPRRDAFDIWGQGTMVTVSSASTKGPSVFPLAPSSKS

SEQ ID NO: 1143 - protein, 107 aa, Artificial Sequence; identical to SEQ ID NO: 336
  Description of Artificial Sequence: Synthetic polypeptide

SEQ ID NO: 1144 - protein, 139 aa, Artificial Sequence
  Description of Artificial Sequence: Synthetic polypeptide
EVQLLESGGGLVQPGGSLRLSCAASGFTFSTYAMVWVRQAPGKGLEWVSSIYPSGGITTYADSVKGRFTISRDNSKNTLYLQMNSLRAEDTAVYYCAYRRTGIPRRDAFDIWGQGTMVTVSSASTKGPSVFPLAPSSKS

SEQ ID NO: 1145 - protein, 107 aa, Artificial Sequence; identical to SEQ ID NO: 336
  Description of Artificial Sequence: Synthetic polypeptide

SEQ ID NO: 1146 - protein, 139 aa, Artificial Sequence
  Description of Artificial Sequence: Synthetic polypeptide
EVQLLESGGGLVQPGGSLRLSCAASGFTFSSYNMHWVRQAPGKGLEWVSSIVPSGGKTNYADSVKGRFTISRDNSKNTLYLQMNSLRAEDTAVYYCAYRRTGIPRRDAFDIWGQGTMVTVSSASTKGPSVFPLAPSSKS

SEQ ID NO: 1147 - protein, 107 aa, Artificial Sequence; identical to SEQ ID NO: 336
  Description of Artificial Sequence: Synthetic polypeptide

SEQ ID NO: 1148 - protein, 139 aa, Artificial Sequence
  Description of Artificial Sequence: Synthetic polypeptide
EVQLLESGGGLVQPGGSLRLSCAASGFTFSIYNMIWVRQAPGKGLEWVSSIYPSGGWTTYADSVKGRFTISRDNSKNTLYLQMNSLRAEDTAVYYCAYRRTGIPRRDAFDIWGQGTMVTVSSASTKGPSVFPLAPSSKS

SEQ ID NO: 1149 - protein, 107 aa, Artificial Sequence; identical to SEQ ID NO: 336
  Description of Artificial Sequence: Synthetic polypeptide

SEQ ID NO: 1150 - protein, 139 aa, Artificial Sequence
  Description of Artificial Sequence: Synthetic polypeptide
EVQLLESGGGLVQPGGSLRLSCAASGFTFSPYTMIWVRQAPGKGLEWVSSISSSGGMTPYADSVKGRFTISRDNSKNTLYLQMNSLRAEDTAVYYCAYRRTGIPRRDAFDIWGQGTMVTVSSASTKGPSVFPLAPSSKS

SEQ ID NO: 1151 - protein, 107 aa, Artificial Sequence; identical to SEQ ID NO: 336
  Description of Artificial Sequence: Synthetic polypeptide

SEQ ID NO: 1152 - protein, 139 aa, Artificial Sequence
  Description of Artificial Sequence: Synthetic polypeptide
EVQLLESGGGLVQPGGSLRLSCAASGFTFSRYSMIWVRQAPGKGLEWVSSIWSSGGATEYADSVKGRFTISRDNSKNTLYLQMNSLRAEDTAVYYCAYRRTGIPRRDAFDIWGQGTMVTVSSASTKGPSVFPLAPSSKS

SEQ ID NO: 1153 - protein, 107 aa, Artificial Sequence; identical to SEQ ID NO: 336
  Description of Artificial Sequence: Synthetic polypeptide

SEQ ID NO: 1154 - protein, 139 aa, Artificial Sequence
  Description of Artificial Sequence: Synthetic polypeptide
EVQLLESGGGLVQPGGSLRLSCAASGFTFSIYSMHWVRQAPGKGLEWVSSIYSSGGPTKYADSVKGRFTISRDNSKNTLYLQMNSLRAEDTAVYYCAYRRTGIPRRDAFDIWGQGTMVTVSSASTKGPSVFPLAPSSKS

SEQ ID NO: 1155 - protein, 107 aa, Artificial Sequence; identical to SEQ ID NO: 336
  Description of Artificial Sequence: Synthetic polypeptide

SEQ ID NO: 1156 - protein, 139 aa, Artificial Sequence
  Description of Artificial Sequence: Synthetic polypeptide
EVQLLESGGGLVQPGGSLRLSCAASGFTFSRYQMHWVRQAPGKGLEWVSWISPSGGITGYADSVKGRFTISRDNSKNTLYLQMNSLRAEDTAVYYCAYRRTGIPRRDAFDIWGQGTMVTVSSASTKGPSVFPLAPSSKS

SEQ ID NO: 1157 - protein, 107 aa, Artificial Sequence; identical to SEQ ID NO: 336
  Description of Artificial Sequence: Synthetic polypeptide

SEQ ID NO: 1158 - protein, 138 aa, Artificial Sequence
  Description of Artificial Sequence: Synthetic polypeptide
EVQLLESGGGLVQPGGSLRLSCAASGFTFSWYMMQWVRQAPGKGLEWVSRISPSGGTTYADSVKGRFTISRDNSKNTLYLQMNSLRAEDTAVYYCAYRRTGIPRRDAFDIWGQGTMVTVSSASTKGPSVFPLAPSSKS

SEQ ID NO: 1159 - protein, 107 aa, Artificial Sequence; identical to SEQ ID NO: 336
  Description of Artificial Sequence: Synthetic polypeptide

SEQ ID NO: 1160 - protein, 139 aa, Artificial Sequence
  Description of Artificial Sequence: Synthetic polypeptide
EVQLLESGGGLVQPGGSLRLSCAASGFTFSIYFMSWVRQAPGKGLEWVSSIRSSGGPTWYADSVKGRFTISRDNSKNTLYLQMNSLRAEDTAVYYCAYRRTGIPRRDAFDIWGQGTMVTVSSASTKGPSVFPLAPSSKS

SEQ ID NO: 1161 - protein, 107 aa, Artificial Sequence; identical to SEQ ID NO: 336
  Description of Artificial Sequence: Synthetic polypeptide

SEQ ID NO: 1162 - protein, 139 aa, Artificial Sequence
  Description of Artificial Sequence: Synthetic polypeptide
EVQLLESGGGLVQPGGSLRLSCAASGFTFSVYSMTWVRQAPGKGLEWVSSIGSSGGSTTYADSVKGRFTISRDNSKNTLYLQMNSLRAEDTAVYYCAYRRTGIPRRDAFDIWGQGTMVTVSSASTKGPSVFPLAPSSKS

SEQ ID NO: 1163 - protein, 107 aa, Artificial Sequence; identical to SEQ ID NO: 336
  Description of Artificial Sequence: Synthetic polypeptide

SEQ ID NO: 1164 - protein, 139 aa, Artificial Sequence
  Description of Artificial Sequence: Synthetic polypeptide
EVQLLESGGGLVQPGGSLRLSCAASGFTFSKYSMAWVRQAPGKGLEWVSGIYPSGGRTLYADSVKGRFTISRDNSKNTLYLQMNSLRAEDTAVYYCAYRRTGIPRRDAFDIWGQGTMVTVSSASTKGPSVFPLAPSSKS

SEQ ID NO: 1165 - protein, 107 aa, Artificial Sequence; identical to SEQ ID NO: 336
  Description of Artificial Sequence: Synthetic polypeptide

SEQ ID NO: 1166 - protein, 139 aa, Artificial Sequence
  Description of Artificial Sequence: Synthetic polypeptide
EVQLLESGGGLVQPGGSLRLSCAASGFTFSRYSMSWVRQAPGKGLEWVSGISPSGGETSYADSVKGRFTISRDNSKNTLYLQMNSLRAEDTAVYYCAYRRTGIPRRDAFDIWGQGTMVTVSSASTKGPSVFPLAPSSKS

SEQ ID NO: 1167 - protein, 107 aa, Artificial Sequence; identical to SEQ ID NO: 336
  Description of Artificial Sequence: Synthetic polypeptide

SEQ ID NO: 1168 - protein, 139 aa, Artificial Sequence
  Description of Artificial Sequence: Synthetic polypeptide
EVQLLESGGGLVQPGGSLRLSCAASGFTFSRYKMYWVRQAPGKGLEWVSVIGPSGGATFYADSVKGRFTISRDNSKNTLYLQMNSLRAEDTAVYYCAYRRTGIPRRDAFDIWGQGTMVTVSSASTKGPSVFPLAPSSKS

SEQ ID NO: 1169 - protein, 107 aa, Artificial Sequence; identical to SEQ ID NO: 336
  Description of Artificial Sequence: Synthetic polypeptide

SEQ ID NO: 1170 - protein, 139 aa, Artificial Sequence
  Description of Artificial Sequence: Synthetic polypeptide
EVQLLESGGGLVQPGGSLRLSCAASGFTFSQYFMHWVRQAPGKGLEWVSYIYPSGGMTEYADSVKGRFTISRDNSKNTLYLQMNSLRAEDTAVYYCAYRRTGIPRRDAFDIWGQGTMVTVSSASTKGPSVFPLAPSSKS

SEQ ID NO: 1171 - protein, 107 aa, Artificial Sequence; identical to SEQ ID NO: 336
  Description of Artificial Sequence: Synthetic polypeptide

SEQ ID NO: 1172 - protein, 139 aa, Artificial Sequence
  Description of Artificial Sequence: Synthetic polypeptide
EVQLLESGGGLVQPGGSLRLSCAASGFTFSIYTMYWVRQAPGKGLEWVSSISPSGGWTYYADSVKGRFTISRDNSKNTLYLQMNSLRAEDTAVYYCAYRRTGIPRRDAFDIWGQGTMVTVSSASTKGPSVFPLAPSSKS

SEQ ID NO: 1173 - protein, 107 aa, Artificial Sequence; identical to SEQ ID NO: 336
  Description of Artificial Sequence: Synthetic polypeptide

SEQ ID NO: 1174 - protein, 140 aa, Artificial Sequence
  Description of Artificial Sequence: Synthetic polypeptide
EVQLLESGGGLVQPGGSLRLSCAASGFTFSHYMGMNWVRQAPGKGLEWVSSIVPSGGWTQYADSVKGRFTISRDNSKNTLYLQMNSLRAEDTAVYYCAYRRTGIPRRDAFDIWGQGTMVTVSSASTKGPSVFPLAPSSKS

SEQ ID NO: 1175 - protein, 107 aa, Artificial Sequence; identical to SEQ ID NO: 336
  Description of Artificial Sequence: Synthetic polypeptide

SEQ ID NO: 1176 - protein, 139 aa, Artificial Sequence
  Description of Artificial Sequence: Synthetic polypeptide
EVQLLESGGGLVQPGGSLRLSCAASGFTFSLYVMYWVRQAPGKGLEWVSYIVPSGGPTAYADSVKGRFTISRDNSKNTLYLQMNSLRAEDTAVYYCAYRRTGIPRRDAFDIWGQGTMVTVSSASTKGPSVFPLAPSSKS

SEQ ID NO: 1177 - protein, 107 aa, Artificial Sequence; identical to SEQ ID NO: 336
  Description of Artificial Sequence: Synthetic polypeptide

SEQ ID NO: 1178 - protein, 139 aa, Artificial Sequence
  Description of Artificial Sequence: Synthetic polypeptide
EVQLLESGGGLVQPGGSLRLSCAASGFTFSIYSMYWVRQAPGKGLEWVSYIRPSGGNTKYADSVKGRFTISRDNSKNTLYLQMNSLRAEDTAVYYCAYRRTGIPRRDAFDIWGQGTMVTVSSASTKGPSVFPLAPSSKS

SEQ ID NO: 1179 - protein, 107 aa, Artificial Sequence; identical to SEQ ID NO: 336
  Description of Artificial Sequence: Synthetic polypeptide

SEQ ID NO: 1180 - protein, 139 aa, Artificial Sequence
  Description of Artificial Sequence: Synthetic polypeptide
EVQLLESGGGLVQPGGSLRLSCAASGFTFSIYDMNWVRQAPGKGLEWVSSIYPSGGRTRYADSVKGRFTISRDNSKNTLYLQMNSLRAEDTAVYYCAYRRTGIPRRDAFDIWGQGTMVTVSSASTKGPSVFPLAPSSKS

SEQ ID NO: 1181 - protein, 107 aa, Artificial Sequence; identical to SEQ ID NO: 336
  Description of Artificial Sequence: Synthetic polypeptide

SEQ ID NO: 1182 - protein, 139 aa, Artificial Sequence
  Description of Artificial Sequence: Synthetic polypeptide
EVQLLESGGGLVQPGGSLRLSCAASGFTFSTYSMYWVRQAPGKGLEWVSSIYPSGGLTWYADSVKGRFTISRDNSKNTLYLQMNSLRAEDTAVYYCAYRRTGIPRRDAFDIWGQGTMVTVSSASTKGPSVFPLAPSSKS

SEQ ID NO: 1183 - protein, 107 aa, Artificial Sequence; identical to SEQ ID NO: 336
  Description of Artificial Sequence: Synthetic polypeptide

SEQ ID NO: 1184 - protein, 139 aa, Artificial Sequence
  Description of Artificial Sequence: Synthetic polypeptide
EVQLLESGGGLVQPGGSLRLSCAASGFTFSIYDMWWVRQAPGKGLEWVSSIRPSGGITKYADSVKGRFTISRDNSKNTLYLQMNSLRAEDTAVYYCAYRRTGIPRRDAFDIWGQGTMVTVSSASTKGPSVFPLAPSSKS

SEQ ID NO: 1185 - protein, 107 aa, Artificial Sequence; identical to SEQ ID NO: 336
  Description of Artificial Sequence: Synthetic polypeptide

SEQ ID NO: 1186 - protein, 139 aa, Artificial Sequence
  Description of Artificial Sequence: Synthetic polypeptide
EVQLLESGGGLVQPGGSLRLSCAASGFTFSVYSMWWVRQAPGKGLEWVSSISSSGGMTEYADSVKGRFTISRDNSKNTLYLQMNSLRAEDTAVYYCAYRRTGIPRRDAFDIWGQGTMVTVSSASTKGPSVFPLAPSSKS

SEQ ID NO: 1187 - protein, 107 aa, Artificial Sequence; identical to SEQ ID NO: 336
  Description of Artificial Sequence: Synthetic polypeptide

SEQ ID NO: 1188 - protein, 139 aa, Artificial Sequence
  Description of Artificial Sequence: Synthetic polypeptide
EVQLLESGGGLVQPGGSLRLSCAASGFTFSVYNMHWVRQAPGKGLEWVSSIYPSGGMTYYADSVKGRFTISRDNSKNTLYLQMNSLRAEDTAVYYCAYRRTGIPRRDAFDIWGQGTMVTVSSASTKGPSVFPLAPSSKS

SEQ ID NO: 1189 - protein, 107 aa, Artificial Sequence; identical to SEQ ID NO: 336
  Description of Artificial Sequence: Synthetic polypeptide

SEQ ID NO: 1190 - protein, 139 aa, Artificial Sequence
  Description of Artificial Sequence: Synthetic polypeptide
EVQLLESGGGLVQPGGSLRLSCAASGFTFSIYTMMWVRQAPGKGLEWVSSIWSSGGQTKYADSVKGRFTISRDNSKNTLYLQMNSLRAEDTAVYYCAYRRTGIPRRDAFDIWGQGTMVTVSSASTKGPSVFPLAPSSKS

SEQ ID NO: 1191 - protein, 107 aa, Artificial Sequence; identical to SEQ ID NO: 336
  Description of Artificial Sequence: Synthetic polypeptide

SEQ ID NO: 1192 - protein, 137 aa, Artificial Sequence
  Description of Artificial Sequence: Synthetic polypeptide
EVQLLESGGGLVQPGGSLRLSCAASGFTFSQYTMVWVRQAPGKGLEWVSWIYSSRANYADSVKGRFTISRDNSKNTLYLQMNSLRAEDTAVYYCAYRRTGIPRRDAFDIWGQGTMVTVSSASTKGPSVFPLAPSSKS

SEQ ID NO: 1193 - protein, 107 aa, Artificial Sequence; identical to SEQ ID NO: 336
  Description of Artificial Sequence: Synthetic polypeptide

SEQ ID NO: 1194 - protein, 139 aa, Artificial Sequence
  Description of Artificial Sequence: Synthetic polypeptide
EVQLLESGGGLVQPGGSLRLSCAASGFTFSIYDMTWVRQAPGKGLEWVSSIYPSGGQTIYADSVKGRFTISRDNSKNTLYLQMNSLRAEDTAVYYCAYRRTGIPRRDAFDIWGQGTMVTVSSASTKGPSVFPLAPSSKS

SEQ ID NO: 1195 - protein, 107 aa, Artificial Sequence; identical to SEQ ID NO: 336
  Description of Artificial Sequence: Synthetic polypeptide

SEQ ID NO: 1196 - protein, 138 aa, Artificial Sequence
  Description of Artificial Sequence: Synthetic polypeptide
EVQLLESGGGLVQPGGSLRLSCAASGFTFSPYNMYWVRQAPGKGLEWVSWIVPGGVTKYADSVKGRFTISRDNSKNTLYLQMNSLRAEDTAVYYCAYRRTGIPRRDAFDIWGQGTMVTVSSASTKGPSVFPLAPSSKS

SEQ ID NO: 1197 - protein, 107 aa, Artificial Sequence; identical to SEQ ID NO: 336
  Description of Artificial Sequence: Synthetic polypeptide

SEQ ID NO: 1198 - protein, 139 aa, Artificial Sequence
  Description of Artificial Sequence: Synthetic polypeptide
EVQLLESGGGLVQPGGSLRLSCAASGFTFSIYDMYWVRQAPGKGLEWVSSIGPSGGPTAYADSVKGRFTISRDNSKNTLYLQMNSLRAEDTAVYYCAYRRTGIPRRDAFDIWGQGTMVTVSSASTKGPSVFPLAPSSKS

SEQ ID NO: 1199 - protein, 107 aa, Artificial Sequence; identical to SEQ ID NO: 336
  Description of Artificial Sequence: Synthetic polypeptide

SEQ ID NO: 1200 - protein, 139 aa, Artificial Sequence
  Description of Artificial Sequence: Synthetic polypeptide
EVQLLESGGGLVQPGGSLRLSCAASGFTFSIYLMIWVRQAPGKGLEWVSYIGPSGGPTEYADSVKGRFTISRDNSKNTLYLQMNSLRAEDTAVYYCAYRRTGIPRRDAFDIWGQGTMVTVSSASTKGPSVFPLAPSSKS

SEQ ID NO: 1201 - protein, 107 aa, Artificial Sequence; identical to SEQ ID NO: 336
  Description of Artificial Sequence: Synthetic polypeptide

SEQ ID NO: 1202 - protein, 139 aa, Artificial Sequence
  Description of Artificial Sequence: Synthetic polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRIGVPRRDEFDIWGQGTMVTVSSASTKGPSVFPLAPSSKS

SEQ ID NO: 1203 - protein, 107 aa, Artificial Sequence; identical to SEQ ID NO: 336
  Description of Artificial Sequence: Synthetic polypeptide

SEQ ID NO: 1204 - protein, 139 aa, Artificial Sequence
  Description of Artificial Sequence: Synthetic polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRRGIPRRDAFDIWGQGTMVTVSSASTKGPSVFPLAPSSKS

SEQ ID NO: 1205 - protein, 107 aa, Artificial Sequence; identical to SEQ ID NO: 336
  Description of Artificial Sequence: Synthetic polypeptide

SEQ ID NO: 1206 - protein, 139 aa, Artificial Sequence
  Description of Artificial Sequence: Synthetic polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAFRRTGIPRRDAFDNWGQGTMVTVSSASTKGPSVFPLAPSSKS

SEQ ID NO: 1207 - protein, 107 aa, Artificial Sequence; identical to SEQ ID NO: 336
  Description of Artificial Sequence: Synthetic polypeptide

SEQ ID NO: 1208 - protein, 139 aa, Artificial Sequence
  Description of Artificial Sequence: Synthetic polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRTGVPRRDSFDIWGQGTMVTVSSASTKGPSVFPLAPSSKS

SEQ ID NO: 1209 - protein, 107 aa, Artificial Sequence; identical to SEQ ID NO: 336
  Description of Artificial Sequence: Synthetic polypeptide

SEQ ID NO: 1210 - protein, 139 aa, Artificial Sequence
  Description of Artificial Sequence: Synthetic polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRTGIPRRDAFDSWGQGTMVTVSSASTKGPSVFPLAPSSKS

SEQ ID NO: 1211 - protein, 107 aa, Artificial Sequence; identical to SEQ ID NO: 336
  Description of Artificial Sequence: Synthetic polypeptide

SEQ ID NO: 1212 - protein, 139 aa, Artificial Sequence
  Description of Artificial Sequence: Synthetic polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAWRRIGVPRRDSFDMWGQGTMVTVSSASTKGPSVFPLAPSSKS

SEQ ID NO: 1213 - protein, 107 aa, Artificial Sequence; identical to SEQ ID NO: 336
  Description of Artificial Sequence: Synthetic polypeptide

SEQ ID NO: 1214 - protein, 139 aa, Artificial Sequence
  Description of Artificial Sequence: Synthetic polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRTGVPRRDAFDNWGQGTMVTVSSASTKGPSVFPLAPSSKS

SEQ ID NO: 1215 - protein, 107 aa, Artificial Sequence; identical to SEQ ID NO: 336
  Description of Artificial Sequence: Synthetic polypeptide

SEQ ID NO: 1216 - protein, 139 aa, Artificial Sequence
  Description of Artificial Sequence: Synthetic polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRMGIPRRNAFDIWGQGTMVTVSSASTKGPSVFPLAPSSKS

SEQ ID NO: 1217 - protein, 107 aa, Artificial Sequence; identical to SEQ ID NO: 336
  Description of Artificial Sequence: Synthetic polypeptide

SEQ ID NO: 1218 - protein, 139 aa, Artificial Sequence
  Description of Artificial Sequence: Synthetic polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRTGVPRRNAFDNWGQGTMVTVSSASTKGPSVFPLAPSSKS

SEQ ID NO: 1219 - protein, 107 aa, Artificial Sequence; identical to SEQ ID NO: 336
  Description of Artificial Sequence: Synthetic polypeptide

SEQ ID NO: 1220 - protein, 139 aa, Artificial Sequence
  Description of Artificial Sequence: Synthetic polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRTGIPRRDVFDIWGQGTMVTVSSASTKGPSVFPLAPSSKS

SEQ ID NO: 1221 - protein, 107 aa, Artificial Sequence; identical to SEQ ID NO: 336
  Description of Artificial Sequence: Synthetic polypeptide

SEQ ID NO: 1222 - protein, 139 aa, Artificial Sequence
  Description of Artificial Sequence: Synthetic polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRTGVPRRDEFDIWGQGTMVTVSSASTKGPSVFPLAPSSKS

SEQ ID NO: 1223 - protein, 107 aa, Artificial Sequence; identical to SEQ ID NO: 336
  Description of Artificial Sequence: Synthetic polypeptide

SEQ ID NO: 1224 - protein, 139 aa, Artificial Sequence
  Description of Artificial Sequence: Synthetic polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRSGIPRRDAFDIWGQGTMVTVSSASTKGPSVFPLAPSSKS

SEQ ID NO: 1225 - protein, 107 aa, Artificial Sequence; identical to SEQ ID NO: 336
  Description of Artificial Sequence: Synthetic polypeptide

SEQ ID NO: 1226 - protein, 139 aa, Artificial Sequence
  Description of Artificial Sequence: Synthetic polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRTGVPRRDAFDIWGQGTMVTVSSASTKGPSVFPLAPSSKS

SEQ ID NO: 1227 - protein, 107 aa, Artificial Sequence; identical to SEQ ID NO: 336
  Description of Artificial Sequence: Synthetic polypeptide

SEQ ID NO: 1228 - protein, 139 aa, Artificial Sequence
  Description of Artificial Sequence: Synthetic polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRTGVPRRDALDNWGQGTMVTVSSASTKGPSVFPLAPSSKS

SEQ ID NO: 1229 - protein, 107 aa, Artificial Sequence; identical to SEQ ID NO: 336
  Description of Artificial Sequence: Synthetic polypeptide

SEQ ID NO: 1230 - protein, 139 aa, Artificial Sequence
  Description of Artificial Sequence: Synthetic polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRIGVPRRDAFDIWGQGTMVTVSSASTKGPSVFPLAPSSKS

SEQ ID NO: 1231 - protein, 107 aa, Artificial Sequence; identical to SEQ ID NO: 336
  Description of Artificial Sequence: Synthetic polypeptide

SEQ ID NO: 1232 - protein, 139 aa, Artificial Sequence
  Description of Artificial Sequence: Synthetic polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRKGIPRRDDFDIWGQGTMVTVSSASTKGPSVFPLAPSSKS

SEQ ID NO: 1233 - protein, 107 aa, Artificial Sequence; identical to SEQ ID NO: 336
  Description of Artificial Sequence: Synthetic polypeptide

SEQ ID NO: 1234 - protein, 139 aa, Artificial Sequence
  Description of Artificial Sequence: Synthetic polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRTGIPRWDAFDIWGQGTMVTVSSASTKGPSVFPLAPSSKS

SEQ ID NO: 1235 - protein, 107 aa, Artificial Sequence; identical to SEQ ID NO: 336
  Description of Artificial Sequence: Synthetic polypeptide

SEQ ID NO: 1236 - protein, 139 aa, Artificial Sequence
  Description of Artificial Sequence: Synthetic polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAFRRTGIPRRDSFDIWGQGTMVTVSSASTKGPSVFPLAPSSKS

SEQ ID NO: 1237 - protein, 107 aa, Artificial Sequence; identical to SEQ ID NO: 336
  Description of Artificial Sequence: Synthetic polypeptide

SEQ ID NO: 1238 - protein, 139 aa, Artificial Sequence
  Description of Artificial Sequence: Synthetic polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYQRTGVPRRDSFNIWGQGTMVTVSSASTKGPSVFPLAPSSKS

SEQ ID NO: 1239 - protein, 107 aa, Artificial Sequence; identical to SEQ ID NO: 336
  Description of Artificial Sequence: Synthetic polypeptide

SEQ ID NO: 1240 - protein, 139 aa, Artificial Sequence
  Description of Artificial Sequence: Synthetic polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRTGVPRRDDFDIWGQGTMVTVSSASTKGPSVFPLAPSSKS

SEQ ID NO: 1241 - protein, 107 aa, Artificial Sequence; identical to SEQ ID NO: 336
  Description of Artificial Sequence: Synthetic polypeptide

SEQ ID NO: 1242 - protein, 139 aa, Artificial Sequence
  Description of Artificial Sequence: Synthetic polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRSGVPRRDDFDIWGQGTMVTVSSASTKGPSVFPLAPSSKS

SEQ ID NO: 1243 - protein, 107 aa, Artificial Sequence; identical to SEQ ID NO: 336
  Description of Artificial Sequence: Synthetic polypeptide

SEQ ID NO: 1244 - protein, 139 aa, Artificial Sequence
  Description of Artificial Sequence: Synthetic polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRTGVPRWDDFDIWGQGTMVTVSSASTKGPSVFPLAPSSKS

SEQ ID NO: 1245 - protein, 107 aa, Artificial Sequence; identical to SEQ ID NO: 336
  Description of Artificial Sequence: Synthetic polypeptide

SEQ ID NO: 1246 - protein, 139 aa, Artificial Sequence
  Description of Artificial Sequence: Synthetic polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRPGVPRRDAFDIWGQGTMVTVSSASTKGPSVFPLAPSSKS

SEQ ID NO: 1247 - protein, 107 aa, Artificial Sequence; identical to SEQ ID NO: 336
  Description of Artificial Sequence: Synthetic polypeptide

SEQ ID NO: 1248 - protein, 139 aa, Artificial Sequence
  Description of Artificial Sequence: Synthetic polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRIGVPRRDDFDIWGQGTMVTVSSASTKGPSVFPLAPSSKS

SEQ ID NO: 1249 - protein, 107 aa, Artificial Sequence; identical to SEQ ID NO: 336
  Description of Artificial Sequence: Synthetic polypeptide

SEQ ID NO: 1250 - protein, 139 aa, Artificial Sequence
  Description of Artificial Sequence: Synthetic polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRIGVPRRDSFDIWGQGTMVTVSSASTKGPSVFPLAPSSKS

SEQ ID NO: 1251 - protein, 107 aa, Artificial Sequence; identical to SEQ ID NO: 336
  Description of Artificial Sequence: Synthetic polypeptide

SEQ ID NO: 1252 - protein, 139 aa, Artificial Sequence
  Description of Artificial Sequence: Synthetic polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRTGIPRRDAFEIWGQGTMVTVSSASTKGPSVFPLAPSSKS

SEQ ID NO: 1253 - protein, 107 aa, Artificial Sequence; identical to SEQ ID NO: 336
  Description of Artificial Sequence: Synthetic polypeptide

SEQ ID NO: 1254 - protein, 139 aa, Artificial Sequence
  Description of Artificial Sequence: Synthetic polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRRGVPRRDDFDIWGQGTMVTVSSASTKGPSVFPLAPSSKS

SEQ ID NO: 1255 - protein, 107 aa, Artificial Sequence; identical to SEQ ID NO: 336
  Description of Artificial Sequence: Synthetic polypeptide

SEQ ID NO: 1256 - protein, 139 aa, Artificial Sequence
  Description of Artificial Sequence: Synthetic polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRTGVPRWDAFDIWGQGTMVTVSSASTKGPSVFPLAPSSKS

SEQ ID NO: 1257 - protein, 107 aa, Artificial Sequence; identical to SEQ ID NO: 336
  Description of Artificial Sequence: Synthetic polypeptide

SEQ ID NO: 1258 - protein, 139 aa, Artificial Sequence
  Description of Artificial Sequence: Synthetic polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAFRRTGVPRRDSFEIWGQGTMVTVSSASTKGPSVFPLAPSSKS

SEQ ID NO: 1259 - protein, 107 aa, Artificial Sequence; identical to SEQ ID NO: 336
  Description of Artificial Sequence: Synthetic polypeptide

SEQ ID NO: 1260 - protein, 139 aa, Artificial Sequence
  Description of Artificial Sequence: Synthetic polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAFRRTGVPRWDDFDIWGQGTMVTVSSASTKGPSVFPLAPSSKS

SEQ ID NO: 1261 - protein, 107 aa, Artificial Sequence; identical to SEQ ID NO: 336
  Description of Artificial Sequence: Synthetic polypeptide

SEQ ID NO: 1262 - protein, 139 aa, Artificial Sequence
  Description of Artificial Sequence: Synthetic polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAFRRTGVPRRDVFDIWGQGTMVTVSSASTKGPSVFPLAPSSKS

SEQ ID NO: 1263 - protein, 12 aa, Artificial Sequence
  Description of Artificial Sequence: Synthetic peptide
RTSQFVNSNYLA

SEQ ID NO: 1264 - protein, 12 aa, Artificial Sequence
  Description of Artificial Sequence: Synthetic peptide
RTSQFVNSNYLA

SEQ ID NO: 1265 - protein, 12 aa, Artificial Sequence
  Description of Artificial Sequence: Synthetic peptide
RTSQFVNSNYLA

SEQ ID NO: 1266 - protein, 12 aa, Artificial Sequence
  Description of Artificial Sequence: Synthetic peptide
RTSQFVNSNYLA

SEQ ID NO: 1267 - protein, 12 aa, Artificial Sequence
  Description of Artificial Sequence: Synthetic peptide
RTSQFVNSNYLA

SEQ ID NO: 1268 - protein, 12 aa, Artificial Sequence
  Description of Artificial Sequence: Synthetic peptide
RTSQFVNSNYLA

SEQ ID NO: 1269 - protein, 12 aa, Artificial Sequence
  Description of Artificial Sequence: Synthetic peptide
RTSQFVNSNYLA

SEQ ID NO: 1270 - protein, 12 aa, Artificial Sequence
  Description of Artificial Sequence: Synthetic peptide
RTSQFVNSNYLA

SEQ ID NO: 1271 - protein, 12 aa, Artificial Sequence
  Description of Artificial Sequence: Synthetic peptide
RTSQFVNSNYLA

SEQ ID NO: 1272 - protein, 12 aa, Artificial Sequence
  Description of Artificial Sequence: Synthetic peptide
RTSQFVNSNYLA

SEQ ID NO: 1273 - protein, 12 aa, Artificial Sequence
  Description of Artificial Sequence: Synthetic peptide
RTSQFVNSNYLA

SEQ ID NO: 1274 - protein, 12 aa, Artificial Sequence
  Description of Artificial Sequence: Synthetic peptide
RTSQFVNSNYLA

SEQ ID NO: 1275 - protein, 12 aa, Artificial Sequence
  Description of Artificial Sequence: Synthetic peptide
RTSQFVNSNYLA

SEQ ID NO: 1276 - protein, 12 aa, Artificial Sequence
  Description of Artificial Sequence: Synthetic peptide
RTSQFVNSNYLA

SEQ ID NO: 1277 - protein, 12 aa, Artificial Sequence
  Description of Artificial Sequence: Synthetic peptide
RTSQFVNSNYLA

SEQ ID NO: 1278 - protein, 12 aa, Artificial Sequence
  Description of Artificial Sequence: Synthetic peptide
RTSQFVNSNYLA

SEQ ID NO: 1279 - protein, 12 aa, Artificial Sequence
  Description of Artificial Sequence: Synthetic peptide
RTSQFVNSNYLA

SEQ ID NO: 1280 - protein, 12 aa, Artificial Sequence
  Description of Artificial Sequence: Synthetic peptide
RTSQFVNSNYLA

SEQ ID NO: 1281 - protein, 12 aa, Artificial Sequence
  Description of Artificial Sequence: Synthetic peptide
RTSQFVNSNYLA

SEQ ID NO: 1282 - protein, 12 aa, Artificial Sequence
  Description of Artificial Sequence: Synthetic peptide
RTSQFVNSNYLA

SEQ ID NO: 1283 - protein, 12 aa, Artificial Sequence
  Description of Artificial Sequence: Synthetic peptide
RTSQFVNSNYLA

SEQ ID NO: 1284 - protein, 12 aa, Artificial Sequence
  Description of Artificial Sequence: Synthetic peptide
RTSQFVNSNYLA

SEQ ID NO: 1285 - protein, 12 aa, Artificial Sequence
  Description of Artificial Sequence: Synthetic peptide
RTSQFVNSNYLA

SEQ ID NO: 1286 - protein, 12 aa, Artificial Sequence
  Description of Artificial Sequence: Synthetic peptide
RTSQFVNSNYLA

SEQ ID NO: 1287 - protein, 12 aa, Artificial Sequence
  Description of Artificial Sequence: Synthetic peptide
RTSQFVNSNYLA

SEQ ID NO: 1288 - protein, 12 aa, Artificial Sequence
  Description of Artificial Sequence: Synthetic peptide
RTSQFVNSNYLA

SEQ ID NO: 1289 - protein, 12 aa, Artificial Sequence
  Description of Artificial Sequence: Synthetic peptide
RTSQFVNSNYLA

SEQ ID NO: 1290 - protein, 12 aa, Artificial Sequence
  Description of Artificial Sequence: Synthetic peptide
RTSQFVNSNYLA

SEQ ID NO: 1291 - protein, 12 aa, Artificial Sequence
  Description of Artificial Sequence: Synthetic peptide
RTSQFVNSNYLA

SEQ ID NO: 1292 - protein, 12 aa, Artificial Sequence
  Description of Artificial Sequence: Synthetic peptide
RTSQFVNSNYLA

SEQ ID NO: 1293 - protein, 12 aa, Artificial Sequence
  Description of Artificial Sequence: Synthetic peptide
RTSQFVNSNYLA

SEQ ID NO: 1294 - protein, 12 aa, Artificial Sequence
  Description of Artificial Sequence: Synthetic peptide
RTSQFVNSNYLA

SEQ ID NO: 1295 - protein, 12 aa, Artificial Sequence
  Description of Artificial Sequence: Synthetic peptide
RTSQFVNSNYLA

SEQ ID NO: 1296 - protein, 12 aa, Artificial Sequence
  Description of Artificial Sequence: Synthetic peptide
RTSQFVNSNYLA

SEQ ID NO: 1297 - protein, 12 aa, Artificial Sequence
  Description of Artificial Sequence: Synthetic peptide
RTSQFVNSNYLA

SEQ ID NO: 1298 - protein, 12 aa, Artificial Sequence
  Description of Artificial Sequence: Synthetic peptide
RTSQFVNSNYLA

SEQ ID NO: 1299 - protein, 12 aa, Artificial Sequence
  Description of Artificial Sequence: Synthetic peptide
RTSQFVNSNYLA

SEQ ID NO: 1300 - protein, 12 aa, Artificial Sequence
  Description of Artificial Sequence: Synthetic peptide
RTSQFVNSNYLA

SEQ ID NO: 1301 - protein, 12 aa, Artificial Sequence
  Description of Artificial Sequence: Synthetic peptide
RTSQFVNSNYLA

SEQ ID NO: 1302 - protein, 12 aa, Artificial Sequence
  Description of Artificial Sequence: Synthetic peptide
RTSQFVNSNYLA

SEQ ID NO: 1303 - protein, 12 aa, Artificial Sequence
  Description of Artificial Sequence: Synthetic peptide
RTSQFVNSNYLA

SEQ ID NO: 1304 - protein, 12 aa, Artificial Sequence
  Description of Artificial Sequence: Synthetic peptide
RTSQFVNSNYLA

SEQ ID NO: 1305 - protein, 12 aa, Artificial Sequence
  Description of Artificial Sequence: Synthetic peptide
RTSQFVNSNYLA

SEQ ID NO: 1306 - protein, 12 aa, Artificial Sequence
  Description of Artificial Sequence: Synthetic peptide
RTSQFVNSNYLA

SEQ ID NO: 1307 - protein, 12 aa, Artificial Sequence
  Description of Artificial Sequence: Synthetic peptide
RTSQFVNSNYLA

SEQ ID NO: 1308 - protein, 12 aa, Artificial Sequence
  Description of Artificial Sequence: Synthetic peptide
RTSQFVNSNYLA

SEQ ID NO: 1309 - protein, 12 aa, Artificial Sequence
  Description of Artificial Sequence: Synthetic peptide
RTSQFVNSNYLA

SEQ ID NO: 1310 - protein, 12 aa, Artificial Sequence
  Description of Artificial Sequence: Synthetic peptide
RTSQFVNSNYLA

SEQ ID NO: 1311 - protein, 12 aa, Artificial Sequence
  Description of Artificial Sequence: Synthetic peptide
RTSQFVNSNYLA

SEQ ID NO: 1312 - protein, 12 aa, Artificial Sequence
  Description of Artificial Sequence: Synthetic peptide
RTSQFVNSNYLA

SEQ ID NO: 1313 - protein, 12 aa, Artificial Sequence
  Description of Artificial Sequence: Synthetic peptide
RTSQFVNSNYLA

SEQ ID NO: 1314 - protein, 12 aa, Artificial Sequence
  Description of Artificial Sequence: Synthetic peptide
RTSQFVNSNYLA

SEQ ID NO: 1315 - protein, 12 aa, Artificial Sequence
  Description of Artificial Sequence: Synthetic peptide
RTSQFVNSNYLA

SEQ ID NO: 1316 - protein, 12 aa, Artificial Sequence
  Description of Artificial Sequence: Synthetic peptide
RTSQFVNSNYLA

SEQ ID NO: 1317 - protein, 12 aa, Artificial Sequence
  Description of Artificial Sequence: Synthetic peptide
RTSQFVNSNYLA

SEQ ID NO: 1318 - protein, 12 aa, Artificial Sequence
  Description of Artificial Sequence: Synthetic peptide
RTSQFVNSNYLA

SEQ ID NO: 1319 - protein, 12 aa, Artificial Sequence
  Description of Artificial Sequence: Synthetic peptide
RTSQFVNSNYLA

SEQ ID NO: 1320 - protein, 12 aa, Artificial Sequence
  Description of Artificial Sequence: Synthetic peptide
RTSQFVNSNYLA

SEQ ID NO: 1321 - protein, 12 aa, Artificial Sequence
  Description of Artificial Sequence: Synthetic peptide
RTSQFVNSNYLA

SEQ ID NO: 1322 - protein, 12 aa, Artificial Sequence
  Description of Artificial Sequence: Synthetic peptide
RTSQFVNSNYLA

SEQ ID NO: 1323 - protein, 12 aa, Artificial Sequence
  Description of Artificial Sequence: Synthetic peptide
RTSQFVNSNYLA

SEQ ID NO: 1324 - protein, 12 aa, Artificial Sequence
  Description of Artificial Sequence: Synthetic peptide
RTSQFVNSNYLA

SEQ ID NO: 1325 - protein, 7 aa, Artificial Sequence
  Description of Artificial Sequence: Synthetic peptide
GASSRAT

SEQ ID NO: 1326 - protein, 7 aa, Artificial Sequence
  Description of Artificial Sequence: Synthetic peptide
GASSRAT

SEQ ID NO: 1327 - protein, 7 aa, Artificial Sequence
  Description of Artificial Sequence: Synthetic peptide
GASSRAT

SEQ ID NO: 1328 - protein, 7 aa, Artificial Sequence
  Description of Artificial Sequence: Synthetic peptide
GASSRAT

SEQ ID NO: 1329 - protein, 7 aa, Artificial Sequence
  Description of Artificial Sequence: Synthetic peptide
GASSRAT

SEQ ID NO: 1330 - protein, 7 aa, Artificial Sequence
  Description of Artificial Sequence: Synthetic peptide
GASSRAT

SEQ ID NO: 1331 - protein, 7 aa, Artificial Sequence
  Description of Artificial Sequence: Synthetic peptide
GASSRAT

SEQ ID NO: 1332 - protein, 7 aa, Artificial Sequence
  Description of Artificial Sequence: Synthetic peptide
GASSRAT

SEQ ID NO: 1333 - protein, 7 aa, Artificial Sequence
  Description of Artificial Sequence: Synthetic peptide
GASSRAT

SEQ ID NO: 1334 - protein, 7 aa, Artificial Sequence
  Description of Artificial Sequence: Synthetic peptide
GASSRAT

SEQ ID NO: 1335 - protein, 7 aa, Artificial Sequence
  Description of Artificial Sequence: Synthetic peptide
GASSRAT

SEQ ID NO: 1336 - protein, 7 aa, Artificial Sequence
  Description of Artificial Sequence: Synthetic peptide
GASSRAT

SEQ ID NO: 1337 - protein, 7 aa, Artificial Sequence
  Description of Artificial Sequence: Synthetic peptide
GASSRAT

SEQ ID NO: 1338 - protein, 7 aa, Artificial Sequence
  Description of Artificial Sequence: Synthetic peptide
GASSRAT

SEQ ID NO: 1339 - protein, 7 aa, Artificial Sequence
  Description of Artificial Sequence: Synthetic peptide
GASSRAT

SEQ ID NO: 1340 - protein, 7 aa, Artificial Sequence
  Description of Artificial Sequence: Synthetic peptide
GASSRAT

SEQ ID NO: 1341 - protein, 7 aa, Artificial Sequence
  Description of Artificial Sequence: Synthetic peptide
GASSRAT

SEQ ID NO: 1342 - protein, 7 aa, Artificial Sequence
  Description of Artificial Sequence: Synthetic peptide
GASSRAT

SEQ ID NO: 1343 - protein, 7 aa, Artificial Sequence
  Description of Artificial Sequence: Synthetic peptide
GASSRAT

SEQ ID NO: 1344 - protein, 7 aa, Artificial Sequence
  Description of Artificial Sequence: Synthetic peptide
GASSRAT

SEQ ID NO: 1345 - protein, 7 aa, Artificial Sequence
  Description of Artificial Sequence: Synthetic peptide
GASSRAT

SEQ ID NO: 1346 - protein, 7 aa, Artificial Sequence
  Description of Artificial Sequence: Synthetic peptide
GASSRAT

SEQ ID NO: 1347 - protein, 7 aa, Artificial Sequence
  Description of Artificial Sequence: Synthetic peptide
GASSRAT

SEQ ID NO: 1348 - protein, 7 aa, Artificial Sequence
  Description of Artificial Sequence: Synthetic peptide
GASSRAT

SEQ ID NO: 1349 - protein, 7 aa, Artificial Sequence
  Description of Artificial Sequence: Synthetic peptide
GASSRAT

SEQ ID NO: 1350 - protein, 7 aa, Artificial Sequence
  Description of Artificial Sequence: Synthetic peptide
GASSRAT

SEQ ID NO: 1351 - protein, 7 aa, Artificial Sequence
  Description of Artificial Sequence: Synthetic peptide
GASSRAT

SEQ ID NO: 1352 - protein, 7 aa, Artificial Sequence
  Description of Artificial Sequence: Synthetic peptide
GASSRAT

SEQ ID NO: 1353 - protein, 7 aa, Artificial Sequence
  Description of Artificial Sequence: Synthetic peptide
GASSRAT

SEQ ID NO: 1354 - protein, 7 aa, Artificial Sequence
  Description of Artificial Sequence: Synthetic peptide
GASSRAT

SEQ ID NO: 1355 - protein, 7 aa, Artificial Sequence
  Description of Artificial Sequence: Synthetic peptide
GASSRAT

SEQ ID NO: 1356 - protein, 7 aa, Artificial Sequence
  Description of Artificial Sequence: Synthetic peptide
GASSRAT

SEQ ID NO: 1357 - protein, 7 aa, Artificial Sequence
  Description of Artificial Sequence: Synthetic peptide
GASSRAT

SEQ ID NO: 1358 - protein, 7 aa, Artificial Sequence
  Description of Artificial Sequence: Synthetic peptide
GASSRAT

SEQ ID NO: 1359 - protein, 7 aa, Artificial Sequence
  Description of Artificial Sequence: Synthetic peptide
GASSRAT

SEQ ID NO: 1360 - protein, 7 aa, Artificial Sequence
  Description of Artificial Sequence: Synthetic peptide
GASSRAT

SEQ ID NO: 1361 - protein, 7 aa, Artificial Sequence
  Description of Artificial Sequence: Synthetic peptide
GASSRAT

SEQ ID NO: 1362 - protein, 7 aa, Artificial Sequence
  Description of Artificial Sequence: Synthetic peptide
GASSRAT

SEQ ID NO: 1363 - protein, 7 aa, Artificial Sequence
  Description of Artificial Sequence: Synthetic peptide
GASSRAT

SEQ ID NO: 1364 - protein, 7 aa, Artificial Sequence
  Description of Artificial Sequence: Synthetic peptide
GASSRAT

SEQ ID NO: 1365 - protein, 7 aa, Artificial Sequence
  Description of Artificial Sequence: Synthetic peptide
GASSRAT

SEQ ID NO: 1366 - protein, 7 aa, Artificial Sequence
  Description of Artificial Sequence: Synthetic peptide
GASSRAT

SEQ ID NO: 1367 - protein, 7 aa, Artificial Sequence
  Description of Artificial Sequence: Synthetic peptide
GASSRAT

SEQ ID NO: 1368 - protein, 7 aa, Artificial Sequence
  Description of Artificial Sequence: Synthetic peptide
GASSRAT

SEQ ID NO: 1369 - protein, 7 aa, Artificial Sequence
  Description of Artificial Sequence: Synthetic peptide
GASSRAT

SEQ ID NO: 1370 - protein, 7 aa, Artificial Sequence
  Description of Artificial Sequence: Synthetic peptide
GASSRAT

SEQ ID NO: 1371 - protein, 7 aa, Artificial Sequence
  Description of Artificial Sequence: Synthetic peptide
GASSRAT

SEQ ID NO: 1372 - protein, 7 aa, Artificial Sequence
  Description of Artificial Sequence: Synthetic peptide
GASSRAT

SEQ ID NO: 1373 - protein, 7 aa, Artificial Sequence
  Description of Artificial Sequence: Synthetic peptide
GASSRAT

SEQ ID NO: 1374 - protein, 7 aa, Artificial Sequence
  Description of Artificial Sequence: Synthetic peptide
GASSRAT

SEQ ID NO: 1375 - protein, 7 aa, Artificial Sequence
  Description of Artificial Sequence: Synthetic peptide
GASSRAT

SEQ ID NO: 1376 - protein, 7 aa, Artificial Sequence
  Description of Artificial Sequence: Synthetic peptide
GASSRAT

SEQ ID NO: 1377 - protein, 7 aa, Artificial Sequence
  Description of Artificial Sequence: Synthetic peptide
GASSRAT

SEQ ID NO: 1378 - protein, 7 aa, Artificial Sequence
  Description of Artificial Sequence: Synthetic peptide
GASSRAT

SEQ ID NO: 1379 - protein, 7 aa, Artificial Sequence
  Description of Artificial Sequence: Synthetic peptide
GASSRAT

SEQ ID NO: 1380 - protein, 7 aa, Artificial Sequence
  Description of Artificial Sequence: Synthetic peptide
GASSRAT

SEQ ID NO: 1381 - protein, 7 aa, Artificial Sequence
  Description of Artificial Sequence: Synthetic peptide
GASSRAT

SEQ ID NO: 1382 - protein, 7 aa, Artificial Sequence
  Description of Artificial Sequence: Synthetic peptide
GASSRAT

SEQ ID NO: 1383 - protein, 7 aa, Artificial Sequence
  Description of Artificial Sequence: Synthetic peptide
GASSRAT

SEQ ID NO: 1384 - protein, 7 aa, Artificial Sequence
  Description of Artificial Sequence: Synthetic peptide
GASSRAT

SEQ ID NO: 1385 - protein, 7 aa, Artificial Sequence
  Description of Artificial Sequence: Synthetic peptide
GASSRAT

SEQ ID NO: 1386 - protein, 7 aa, Artificial Sequence
  Description of Artificial Sequence: Synthetic peptide
GASSRAT

SEQ ID NO: 1387 - protein, 9 aa, Artificial Sequence
  Description of Artificial Sequence: Synthetic peptide
QQSSRTPWT

SEQ ID NO: 1388 - protein, 9 aa, Artificial Sequence
  Description of Artificial Sequence: Synthetic peptide
QQSSRTPWT

SEQ ID NO: 1389 - protein, 9 aa, Artificial Sequence
  Description of Artificial Sequence: Synthetic peptide
QQSSRTPWT

SEQ ID NO: 1390 - protein, 9 aa, Artificial Sequence
  Description of Artificial Sequence: Synthetic peptide
QQSSRTPWT

SEQ ID NO: 1391 - protein, 9 aa, Artificial Sequence
  Description of Artificial Sequence: Synthetic peptide
QQSSRTPWT

SEQ ID NO: 1392 - protein, 9 aa, Artificial Sequence
  Description of Artificial Sequence: Synthetic peptide
QQSSRTPWT

SEQ ID NO: 1393 - protein, 9 aa, Artificial Sequence
  Description of Artificial Sequence: Synthetic peptide
QQSSRTPWT

SEQ ID NO: 1394 - protein, 9 aa, Artificial Sequence
  Description of Artificial Sequence: Synthetic peptide
QQSSRTPWT

SEQ ID NO: 1395 - protein, 9 aa, Artificial Sequence
  Description of Artificial Sequence: Synthetic peptide
QQSSRTPWT

SEQ ID NO: 1396 - protein, 9 aa, Artificial Sequence
  Description of Artificial Sequence: Synthetic peptide
QQSSRTPWT

SEQ ID NO: 1397 - protein, 9 aa, Artificial Sequence
  Description of Artificial Sequence: Synthetic peptide
QQSSRTPWT

SEQ ID NO: 1398 - protein, 9 aa, Artificial Sequence
  Description of Artificial Sequence: Synthetic peptide
QQSSRTPWT

SEQ ID NO: 1399 - protein, 9 aa, Artificial Sequence
  Description of Artificial Sequence: Synthetic peptide
QQSSRTPWT

SEQ ID NO: 1400 - protein, 9 aa, Artificial Sequence
  Description of Artificial Sequence: Synthetic peptide
QQSSRTPWT

SEQ ID NO: 1401 - protein, 9 aa, Artificial Sequence
  Description of Artificial Sequence: Synthetic peptide
QQSSRTPWT

SEQ ID NO: 1402 - protein, 9 aa, Artificial Sequence
  Description of Artificial Sequence: Synthetic peptide
QQSSRTPWT

SEQ ID NO: 1403 - protein, 9 aa, Artificial Sequence
  Description of Artificial Sequence: Synthetic peptide
QQSSRTPWT

SEQ ID NO: 1404 - protein, 9 aa, Artificial Sequence
  Description of Artificial Sequence: Synthetic peptide
QQSSRTPWT

SEQ ID NO: 1405 - protein, 9 aa, Artificial Sequence
  Description of Artificial Sequence: Synthetic peptide
QQSSRTPWT

SEQ ID NO: 1406 - protein, 9 aa, Artificial Sequence
  Description of Artificial Sequence: Synthetic peptide
QQSSRTPWT

SEQ ID NO: 1407 - protein, 9 aa, Artificial Sequence
  Description of Artificial Sequence: Synthetic peptide
QQSSRTPWT

SEQ ID NO: 1408 - protein, 9 aa, Artificial Sequence
  Description of Artificial Sequence: Synthetic peptide
QQSSRTPWT

SEQ ID NO: 1409 - protein, 9 aa, Artificial Sequence
  Description of Artificial Sequence: Synthetic peptide
QQSSRTPWT

SEQ ID NO: 1410 - protein, 9 aa, Artificial Sequence
  Description of Artificial Sequence: Synthetic peptide
QQSSRTPWT

SEQ ID NO: 1411 - protein, 9 aa, Artificial Sequence
  Description of Artificial Sequence: Synthetic peptide
QQSSRTPWT

SEQ ID NO: 1412 - protein, 9 aa, Artificial Sequence
  Description of Artificial Sequence: Synthetic peptide
QQSSRTPWT

SEQ ID NO: 1413 - protein, 9 aa, Artificial Sequence
  Description of Artificial Sequence: Synthetic peptide
QQSSRTPWT

SEQ ID NO: 1414 - protein, 9 aa, Artificial Sequence
  Description of Artificial Sequence: Synthetic peptide
QQSSRTPWT

SEQ ID NO: 1415 - protein, 9 aa, Artificial Sequence
  Description of Artificial Sequence: Synthetic peptide
QQSSRTPWT

SEQ ID NO: 1416 - protein, 9 aa, Artificial Sequence
  Description of Artificial Sequence: Synthetic peptide
QQSSRTPWT

SEQ ID NO: 1417 - protein, 9 aa, Artificial Sequence
  Description of Artificial Sequence: Synthetic peptide
QQSSRTPWT

SEQ ID NO: 1418 - protein, 9 aa, Artificial Sequence
  Description of Artificial Sequence: Synthetic peptide
QQSSRTPWT

SEQ ID NO: 1419 - protein, 9 aa, Artificial Sequence
  Description of Artificial Sequence: Synthetic peptide
QQSSRTPWT

SEQ ID NO: 1420 - protein, 9 aa, Artificial Sequence
  Description of Artificial Sequence: Synthetic peptide
QQSSRTPWT

SEQ ID NO: 1421 - protein, 9 aa, Artificial Sequence
  Description of Artificial Sequence: Synthetic peptide
QQSSRTPWT

SEQ ID NO: 1422 - protein, 9 aa, Artificial Sequence
  Description of Artificial Sequence: Synthetic peptide
QQSSRTPWT

SEQ ID NO: 1423 - protein, 9 aa, Artificial Sequence
  Description of Artificial Sequence: Synthetic peptide
QQSSRTPWT

SEQ ID NO: 1424 - protein, 9 aa, Artificial Sequence
  Description of Artificial Sequence: Synthetic peptide
QQSSRTPWT

SEQ ID NO: 1425 - protein, 9 aa, Artificial Sequence
  Description of Artificial Sequence: Synthetic peptide
QQSSRTPWT

SEQ ID NO: 1426 - protein, 9 aa, Artificial Sequence
  Description of Artificial Sequence: Synthetic peptide
QQSSRTPWT

SEQ ID NO: 1427 - protein, 9 aa, Artificial Sequence
  Description of Artificial Sequence: Synthetic peptide
QQSSRTPWT

SEQ ID NO: 1428 - protein, 9 aa, Artificial Sequence
  Description of Artificial Sequence: Synthetic peptide
QQSSRTPWT

SEQ ID NO: 1429 - protein, 9 aa, Artificial Sequence
  Description of Artificial Sequence: Synthetic peptide
QQSSRTPWT

SEQ ID NO: 1430 - protein, 9 aa, Artificial Sequence
  Description of Artificial Sequence: Synthetic peptide
QQSSRTPWT

SEQ ID NO: 1431 - protein, 9 aa, Artificial Sequence
  Description of Artificial Sequence: Synthetic peptide
QQSSRTPWT

SEQ ID NO: 1432 - protein, 9 aa, Artificial Sequence
  Description of Artificial Sequence: Synthetic peptide
QQSSRTPWT

SEQ ID NO: 1433 - protein, 9 aa, Artificial Sequence
  Description of Artificial Sequence: Synthetic peptide
QQSSRTPWT

SEQ ID NO: 1434 - protein, 9 aa, Artificial Sequence
  Description of Artificial Sequence: Synthetic peptide
QQSSRTPWT

SEQ ID NO: 1435 - protein, 9 aa, Artificial Sequence
  Description of Artificial Sequence: Synthetic peptide
QQSSRTPWT

SEQ ID NO: 1436 - protein, 9 aa, Artificial Sequence
  Description of Artificial Sequence: Synthetic peptide
QQSSRTPWT

SEQ ID NO: 1437 - protein, 9 aa, Artificial Sequence
  Description of Artificial Sequence: Synthetic peptide
QQSSRTPWT

SEQ ID NO: 1438 - protein, 9 aa, Artificial Sequence
  Description of Artificial Sequence: Synthetic peptide
QQSSRTPWT

SEQ ID NO: 1439 - protein, 9 aa, Artificial Sequence
  Description of Artificial Sequence: Synthetic peptide
QQSSRTPWT

SEQ ID NO: 1440 - protein, 9 aa, Artificial Sequence
  Description of Artificial Sequence: Synthetic peptide
QQSSRTPWT

SEQ ID NO: 1441 - protein, 9 aa, Artificial Sequence
  Description of Artificial Sequence: Synthetic peptide
QQSSRTPWT

SEQ ID NO: 1442 - protein, 9 aa, Artificial Sequence
  Description of Artificial Sequence: Synthetic peptide
QQSSRTPWT

SEQ ID NO: 1443 - protein, 9 aa, Artificial Sequence
  Description of Artificial Sequence: Synthetic peptide
QQSSRTPWT

SEQ ID NO: 1444 - protein, 9 aa, Artificial Sequence
  Description of Artificial Sequence: Synthetic peptide
QQSSRTPWT

SEQ ID NO: 1445 - protein, 9 aa, Artificial Sequence
  Description of Artificial Sequence: Synthetic peptide
QQSSRTPWT

SEQ ID NO: 1446 - protein, 9 aa, Artificial Sequence
  Description of Artificial Sequence: Synthetic peptide
QQSSRTPWT

SEQ ID NO: 1447 - protein, 9 aa, Artificial Sequence
  Description of Artificial Sequence: Synthetic peptide
QQSSRTPWT

SEQ ID NO: 1448 - protein, 9 aa, Artificial Sequence
  Description of Artificial Sequence: Synthetic peptide
QQSSRTPWT

SEQ ID NO: 1449 - protein, 5 aa, Artificial Sequence
  Description of Artificial Sequence: Synthetic peptide
HYLMT

SEQ ID NO: 1450 - protein, 5 aa, Artificial Sequence
  Description of Artificial Sequence: Synthetic peptide
HYLMT

SEQ ID NO: 1451 - protein, 5 aa, Artificial Sequence
  Description of Artificial Sequence: Synthetic peptide
DYMMA

SEQ ID NO: 1452 - protein, 5 aa, Artificial Sequence
  Description of Artificial Sequence: Synthetic peptide
HYLMT

SEQ ID NO: 1453 - protein, 5 aa, Artificial Sequence
  Description of Artificial Sequence: Synthetic peptide
HYLMT

SEQ ID NO: 1454 - protein, 5 aa, Artificial Sequence
  Description of Artificial Sequence: Synthetic peptide
QYLMA

SEQ ID NO: 1455 - protein, 5 aa, Artificial Sequence
  Description of Artificial Sequence: Synthetic peptide
HYLMT

SEQ ID NO: 1456 - protein, 5 aa, Artificial Sequence
  Description of Artificial Sequence: Synthetic peptide
HYLMT

SEQ ID NO: 1457 - protein, 5 aa, Artificial Sequence
  Description of Artificial Sequence: Synthetic peptide
HYLMT

SEQ ID NO: 1458 - protein, 5 aa, Artificial Sequence
  Description of Artificial Sequence: Synthetic peptide
HYLMT

SEQ ID NO: 1459 - protein, 5 aa, Artificial Sequence
  Description of Artificial Sequence: Synthetic peptide
HYLMT

SEQ ID NO: 1460 - protein, 5 aa, Artificial Sequence
  Description of Artificial Sequence: Synthetic peptide
HYLMT

SEQ ID NO: 1461 - protein, 5 aa, Artificial Sequence
  Description of Artificial Sequence: Synthetic peptide
HYLMT

SEQ ID NO: 1462 - protein, 5 aa, Artificial Sequence
  Description of Artificial Sequence: Synthetic peptide
NYMMG

SEQ ID NO: 1463 - protein, 5 aa, Artificial Sequence
  Description of Artificial Sequence: Synthetic peptide
HYLMT

SEQ ID NO: 1464 - protein, 5 aa, Artificial Sequence
  Description of Artificial Sequence: Synthetic peptide
GYMMV

SEQ ID NO: 1465 - protein, 5 aa, Artificial Sequence
  Description of Artificial Sequence: Synthetic peptide
HYLMT

SEQ ID NO: 1466 - protein, 5 aa, Artificial Sequence
  Description of Artificial Sequence: Synthetic peptide
HYLMT

SEQ ID NO: 1467 - protein, 5 aa, Artificial Sequence
  Description of Artificial Sequence: Synthetic peptide
HYLMT

SEQ ID NO: 1468 - protein, 5 aa, Artificial Sequence
  Description of Artificial Sequence: Synthetic peptide
TYKMQ

SEQ ID NO: 1469 - protein, 5 aa, Artificial Sequence
  Description of Artificial Sequence: Synthetic peptide
HYLMT

SEQ ID NO: 1470 - protein, 5 aa, Artificial Sequence
  Description of Artificial Sequence: Synthetic peptide
HYLMT

SEQ ID NO: 1471 - protein, 5 aa, Artificial Sequence
  Description of Artificial Sequence: Synthetic peptide
HYLMT

SEQ ID NO: 1472 - protein, 5 aa, Artificial Sequence
  Description of Artificial Sequence: Synthetic peptide
HYLMT

SEQ ID NO: 1473 - protein, 5 aa, Artificial Sequence
  Description of Artificial Sequence: Synthetic peptide
HYLMT

SEQ ID NO: 1474 - protein, 5 aa, Artificial Sequence
  Description of Artificial Sequence: Synthetic peptide
DYMMT

SEQ ID NO: 1475 - protein, 5 aa, Artificial Sequence
  Description of Artificial Sequence: Synthetic peptide
EYMMV

SEQ ID NO: 1476 - protein, 5 aa, Artificial Sequence
  Description of Artificial Sequence: Synthetic peptide
HYLMT

SEQ ID NO: 1477 - protein, 5 aa, Artificial Sequence
  Description of Artificial Sequence: Synthetic peptide
VYMMS

SEQ ID NO: 1478 - protein, 5 aa, Artificial Sequence
  Description of Artificial Sequence: Synthetic peptide
HYLMT

SEQ ID NO: 1479 - protein, 5 aa, Artificial Sequence
  Description of Artificial Sequence: Synthetic peptide
HYLMT

SEQ ID NO: 1480 - protein, 5 aa, Artificial Sequence
  Description of Artificial Sequence: Synthetic peptide
QYMMM

SEQ ID NO: 1481 - protein, 5 aa, Artificial Sequence
  Description of Artificial Sequence: Synthetic peptide
DYMMM

SEQ ID NO: 1482 - protein, 5 aa, Artificial Sequence
  Description of Artificial Sequence: Synthetic peptide
HYLMT

SEQ ID NO: 1483 - protein, 5 aa, Artificial Sequence
  Description of Artificial Sequence: Synthetic peptide
HYLMT

SEQ ID NO: 1484 - protein, 5 aa, Artificial Sequence
  Description of Artificial Sequence: Synthetic peptide
HYLMT

SEQ ID NO: 1485 - protein, 5 aa, Artificial Sequence
  Description of Artificial Sequence: Synthetic peptide
TYMMQ

SEQ ID NO: 1486 - protein, 5 aa, Artificial Sequence
  Description of Artificial Sequence: Synthetic peptide
HYLMT

SEQ ID NO: 1487 - protein, 5 aa, Artificial Sequence
  Description of Artificial Sequence: Synthetic peptide
GYKMQ

SEQ ID NO: 1488 - protein, 5 aa, Artificial Sequence
  Description of Artificial Sequence: Synthetic peptide
HYLMT

SEQ ID NO: 1489 - protein, 5 aa, Artificial Sequence
  Description of Artificial Sequence: Synthetic peptide
TYLMA

SEQ ID NO: 1490 - protein, 5 aa, Artificial Sequence
  Description of Artificial Sequence: Synthetic peptide
HYLMT

SEQ ID NO: 1491 - protein, 5 aa, Artificial Sequence
  Description of Artificial Sequence: Synthetic peptide
NYTMG

SEQ ID NO: 1492 - protein, 5 aa, Artificial Sequence
  Description of Artificial Sequence: Synthetic peptide
EYMMM

SEQ ID NO: 1493 - protein, 5 aa, Artificial Sequence
  Description of Artificial Sequence: Synthetic peptide
NYTMQ

SEQ ID NO: 1494 - protein, 5 aa, Artificial Sequence
  Description of Artificial Sequence: Synthetic peptide
HYLMT

SEQ ID NO: 1495 - protein, 5 aa, Artificial Sequence
  Description of Artificial Sequence: Synthetic peptide
HYLMT

SEQ ID NO: 1496 - protein, 5 aa, Artificial Sequence
  Description of Artificial Sequence: Synthetic peptide
HYLMT

SEQ ID NO: 1497 - protein, 5 aa, Artificial Sequence
  Description of Artificial Sequence: Synthetic peptide
HYLMT

SEQ ID NO: 1498 - protein, 5 aa, Artificial Sequence
  Description of Artificial Sequence: Synthetic peptide
HYLMT

SEQ ID NO: 1499 - protein, 5 aa, Artificial Sequence
  Description of Artificial Sequence: Synthetic peptide
NYDMI

SEQ ID NO: 1500 - protein, 5 aa, Artificial Sequence
  Description of Artificial Sequence: Synthetic peptide
VYMMI

SEQ ID NO: 1501 - protein, 5 aa, Artificial Sequence
  Description of Artificial Sequence: Synthetic peptide
HYLMT

SEQ ID NO: 1502 - protein, 5 aa, Artificial Sequence
  Description of Artificial Sequence: Synthetic peptide
HYLMT

SEQ ID NO: 1503 - protein, 5 aa, Artificial Sequence
  Description of Artificial Sequence: Synthetic peptide
QYMMV

SEQ ID NO: 1504 - protein, 5 aa, Artificial Sequence
  Description of Artificial Sequence: Synthetic peptide
HYLMT

SEQ ID NO: 1505 - protein, 5 aa, Artificial Sequence
  Description of Artificial Sequence: Synthetic peptide
QYDMI

SEQ ID NO: 1506 - protein, 5 aa, Artificial Sequence
  Description of Artificial Sequence: Synthetic peptide
SQQMV

SEQ ID NO: 1507 - protein, 5 aa, Artificial Sequence
  Description of Artificial Sequence: Synthetic peptide
NYLMA

SEQ ID NO: 1508 - protein, 5 aa, Artificial Sequence
  Description of Artificial Sequence: Synthetic peptide
HYLMT

SEQ ID NO: 1509 - protein, 5 aa, Artificial Sequence
  Description of Artificial Sequence: Synthetic peptide
HYLMT

SEQ ID NO: 1510 - protein, 5 aa, Artificial Sequence
  Description of Artificial Sequence: Synthetic peptide
SYMMV

SEQ ID NO: 1511 - protein, 17 aa, Artificial Sequence
  Description of Artificial Sequence: Synthetic peptide
YISPSGGHTIYADSVKG

SEQ ID NO: 1512 - protein, 17 aa, Artificial Sequence
  Description of Artificial Sequence: Synthetic peptide
YISPSGGHTIYADSVKG

SEQ ID NO: 1513 - protein, 17 aa, Artificial Sequence
  Description of Artificial Sequence: Synthetic peptide
SIVPSGGHTHYADSVKG

SEQ ID NO: 1514 - protein, 17 aa, Artificial Sequence
  Description of Artificial Sequence: Synthetic peptide
YISPSGGHTIYADSVKG

SEQ ID NO: 1515 - protein, 17 aa, Artificial Sequence
  Description of Artificial Sequence: Synthetic peptide
YISPSGGHTIYADSVKG

SEQ ID NO: 1516 - protein, 17 aa, Artificial Sequence
  Description of Artificial Sequence: Synthetic peptide
SIYPSGGWTKYADSVKG

SEQ ID NO: 1517 - protein, 17 aa, Artificial Sequence
  Description of Artificial Sequence: Synthetic peptide
YISPSGGHTIYADSVKG

SEQ ID NO: 1518 - protein, 17 aa, Artificial Sequence
  Description of Artificial Sequence: Synthetic peptide
YISPSGGHTIYADSVKG

SEQ ID NO: 1519 - protein, 17 aa, Artificial Sequence
  Description of Artificial Sequence: Synthetic peptide
YISPSGGHTIYADSVKG

SEQ ID NO: 1520 - protein, 17 aa, Artificial Sequence
  Description of Artificial Sequence: Synthetic peptide
YISPSGGHTIYADSVKG

SEQ ID NO: 1521 - protein, 17 aa, Artificial Sequence
  Description of Artificial Sequence: Synthetic peptide
YISPSGGHTIYADSVKG

SEQ ID NO: 1522 - protein, 17 aa, Artificial Sequence
  Description of Artificial Sequence: Synthetic peptide
YISPSGGHTIYADSVKG

SEQ ID NO: 1523 - protein, 17 aa, Artificial Sequence
  Description of Artificial Sequence: Synthetic peptide
YISPSGGHTIYADSVKG

SEQ ID NO: 1524 - protein, 17 aa, Artificial Sequence
  Description of Artificial Sequence: Synthetic peptide
SISPSGGLTKYADSVKG

SEQ ID NO: 1525 - protein, 17 aa, Artificial Sequence
  Description of Artificial Sequence: Synthetic peptide
YISPSGGHTIYADSVKG

SEQ ID NO: 1526 - protein, 17 aa, Artificial Sequence
  Description of Artificial Sequence: Synthetic peptide
RISPSGGPTIYADSVKG

SEQ ID NO: 1527 - protein, 17 aa, Artificial Sequence
  Description of Artificial Sequence: Synthetic peptide
YISPSGGHTIYADSVKG

SEQ ID NO: 1528 - protein, 17 aa, Artificial Sequence
  Description of Artificial Sequence: Synthetic peptide
YISPSGGHTIYADSVKG

SEQ ID NO: 1529 - protein, 17 aa, Artificial Sequence
  Description of Artificial Sequence: Synthetic peptide
YISPSGGHTIYADSVKG

SEQ ID NO: 1530 - protein, 17 aa, Artificial Sequence
  Description of Artificial Sequence: Synthetic peptide
SISPSGGPTNYADSVKG

SEQ ID NO: 1531 - protein, 17 aa, Artificial Sequence
  Description of Artificial Sequence: Synthetic peptide
YISPSGGHTIYADSVKG

SEQ ID NO: 1532 - protein, 17 aa, Artificial Sequence
  Description of Artificial Sequence: Synthetic peptide
YISPSGGHTIYADSVKG

SEQ ID NO: 1533 - protein, 17 aa, Artificial Sequence
  Description of Artificial Sequence: Synthetic peptide
YISPSGGHTIYADSVKG

SEQ ID NO: 1534 - protein, 17 aa, Artificial Sequence
  Description of Artificial Sequence: Synthetic peptide
YISPSGGHTIYADSVKG

SEQ ID NO: 1535 - protein, 17 aa, Artificial Sequence
  Description of Artificial Sequence: Synthetic peptide
YISPSGGHTIYADSVKG

SEQ ID NO: 1536 - protein, 17 aa, Artificial Sequence
  Description of Artificial Sequence: Synthetic peptide
YISPSGGLTSYADSVKG

SEQ ID NO: 1537 - protein, 17 aa, Artificial Sequence
  Description of Artificial Sequence: Synthetic peptide
RISPSGGTTEYADSVKG

SEQ ID NO: 1538 - protein, 17 aa, Artificial Sequence
  Description of Artificial Sequence: Synthetic peptide
YISPSGGHTIYADSVKG

SEQ ID NO: 1539 - protein, 17 aa, Artificial Sequence
  Description of Artificial Sequence: Synthetic peptide
SIVPSGGSTTYADSVKG

SEQ ID NO: 1540 - protein, 17 aa, Artificial Sequence
  Description of Artificial Sequence: Synthetic peptide
YISPSGGHTIYADSVKG

SEQ ID NO: 1541 - protein, 17 aa, Artificial Sequence
  Description of Artificial Sequence: Synthetic peptide
YISPSGGHTIYADSVKG

SEQ ID NO: 1542 - protein, 17 aa, Artificial Sequence
  Description of Artificial Sequence: Synthetic peptide
RISPSGGSTLYADSVKG

SEQ ID NO: 1543 - protein, 17 aa, Artificial Sequence
  Description of Artificial Sequence: Synthetic peptide
SIVPSGGHTQYADSVKG

SEQ ID NO: 1544 - protein, 17 aa, Artificial Sequence
  Description of Artificial Sequence: Synthetic peptide
YISPSGGHTIYADSVKG

SEQ ID NO: 1545 - protein, 17 aa, Artificial Sequence
  Description of Artificial Sequence: Synthetic peptide
YISPSGGHTIYADSVKG

SEQ ID NO: 1546 - protein, 17 aa, Artificial Sequence
  Description of Artificial Sequence: Synthetic peptide
YISPSGGHTIYADSVKG

SEQ ID NO: 1547 - protein, 17 aa, Artificial Sequence
  Description of Artificial Sequence: Synthetic peptide
YIGPSGGKTDYADSVKG

SEQ ID NO: 1548 - protein, 17 aa, Artificial Sequence
  Description of Artificial Sequence: Synthetic peptide
YISPSGGHTIYADSVKG

SEQ ID NO: 1549 - protein, 17 aa, Artificial Sequence
  Description of Artificial Sequence: Synthetic peptide
SISPSGGITMYADSVKG

SEQ ID NO: 1550 - protein, 17 aa, Artificial Sequence
  Description of Artificial Sequence: Synthetic peptide
YISPSGGHTIYADSVKG

SEQ ID NO: 1551 - protein, 17 aa, Artificial Sequence
  Description of Artificial Sequence: Synthetic peptide
GIVSSGGRTLYADSVKG

SEQ ID NO: 1552 - protein, 17 aa, Artificial Sequence
  Description of Artificial Sequence: Synthetic peptide
YISPSGGHTIYADSVKG

SEQ ID NO: 1553 - protein, 17 aa, Artificial Sequence
  Description of Artificial Sequence: Synthetic peptide
SISPSGGKTDYADSVKG

SEQ ID NO: 1554 - protein, 17 aa, Artificial Sequence
  Description of Artificial Sequence: Synthetic peptide
VISPSGGQTHYADSVKG

SEQ ID NO: 1555 - protein, 17 aa, Artificial Sequence
  Description of Artificial Sequence: Synthetic peptide
YISPSGGYTGYADSVKG

SEQ ID NO: 1556 - protein, 17 aa, Artificial Sequence
  Description of Artificial Sequence: Synthetic peptide
YISPSGGHTIYADSVKG

SEQ ID NO: 1557 - protein, 17 aa, Artificial Sequence
  Description of Artificial Sequence: Synthetic peptide
YISPSGGHTIYADSVKG

SEQ ID NO: 1558 - protein, 17 aa, Artificial Sequence
  Description of Artificial Sequence: Synthetic peptide
YISPSGGHTIYADSVKG

SEQ ID NO: 1559 - protein, 17 aa, Artificial Sequence
  Description of Artificial Sequence: Synthetic peptide
YISPSGGHTIYADSVKG

SEQ ID NO: 1560 - protein, 17 aa, Artificial Sequence
  Description of Artificial Sequence: Synthetic peptide
YISPSGGHTIYADSVKG

SEQ ID NO: 1561 - protein, 17 aa, Artificial Sequence
  Description of Artificial Sequence: Synthetic peptide
SISSSGGTTKYADSVKG

SEQ ID NO: 1562 - protein, 17 aa, Artificial Sequence
  Description of Artificial Sequence: Synthetic peptide
SISPSGGQTTYADSVKG

SEQ ID NO: 1563 - protein, 17 aa, Artificial Sequence
  Description of Artificial Sequence: Synthetic peptide
YISPSGGHTIYADSVKG

SEQ ID NO: 1564 - protein, 17 aa, Artificial Sequence
  Description of Artificial Sequence: Synthetic peptide
YISPSGGHTIYADSVKG

SEQ ID NO: 1565 - protein, 17 aa, Artificial Sequence
  Description of Artificial Sequence: Synthetic peptide
SIYSSGGNTPYADSVKG

SEQ ID NO: 1566 - protein, 17 aa, Artificial Sequence
  Description of Artificial Sequence: Synthetic peptide
YISPSGGHTIYADSVKG

SEQ ID NO: 1567 - protein, 17 aa, Artificial Sequence
  Description of Artificial Sequence: Synthetic peptide
YISSSGGFTRYADSVKG

SEQ ID NO: 1568 - protein, 17 aa, Artificial Sequence
  Description of Artificial Sequence: Synthetic peptide
YISPSGGNTYYADSVKG

SEQ ID NO: 1569 - protein, 17 aa, Artificial Sequence
  Description of Artificial Sequence: Synthetic peptide
WIVPSGGYTEYADSVKG

SEQ ID NO: 1570 - protein, 17 aa, Artificial Sequence
  Description of Artificial Sequence: Synthetic peptide
YISPSGGHTIYADSVKG

SEQ ID NO: 1571 - protein, 17 aa, Artificial Sequence
  Description of Artificial Sequence: Synthetic peptide
YISPSGGHTIYADSVKG

SEQ ID NO: 1572 - protein, 17 aa, Artificial Sequence
  Description of Artificial Sequence: Synthetic peptide
SISPSGGYTIQADSVKG

SEQ ID NO: 1573 - protein, 16 aa, Artificial Sequence
  Description of Artificial Sequence: Synthetic peptide
VARGIAARSRTSYLDQ

SEQ ID NO: 1574 - protein, 16 aa, Artificial Sequence
  Description of Artificial Sequence: Synthetic peptide
VGQGIRGRSRTSYFAQ

SEQ ID NO: 1575 - protein, 16 aa, Artificial Sequence
  Description of Artificial Sequence: Synthetic peptide
VARGIAARSRTSYFDY

SEQ ID NO: 1576 - protein, 16 aa, Artificial Sequence
  Description of Artificial Sequence: Synthetic peptide
VAQGIAARSRTSSVDQ

SEQ ID NO: 1577 - protein, 16 aa, Artificial Sequence
  Description of Artificial Sequence: Synthetic peptide
VARGIAARSRTSFFDY

SEQ ID NO: 1578 - protein, 16 aa, Artificial Sequence
  Description of Artificial Sequence: Synthetic peptide
VARGIAARSRTSYFDY

SEQ ID NO: 1579 - protein, 16 aa, Artificial Sequence
  Description of Artificial Sequence: Synthetic peptide
VARGIASRSRTRYCDY

SEQ ID NO: 1580 - protein, 16 aa, Artificial Sequence
  Description of Artificial Sequence: Synthetic peptide
VATGIVARSRTRYFDQ

SEQ ID NO: 1581 - protein, 16 aa, Artificial Sequence
  Description of Artificial Sequence: Synthetic peptide
VARGIAARSRTRYFDY

SEQ ID NO: 1582 - protein, 16 aa, Artificial Sequence
  Description of Artificial Sequence: Synthetic peptide
VAQGISARSRTSYFDY

SEQ ID NO: 1583 - protein, 16 aa, Artificial Sequence
  Description of Artificial Sequence: Synthetic peptide
VAQGIVARSRTSYLHQ

SEQ ID NO: 1584 - protein, 16 aa, Artificial Sequence
  Description of Artificial Sequence: Synthetic peptide
VGRGIAARSRTSQLDY

SEQ ID NO: 1585 - protein, 16 aa, Artificial Sequence
  Description of Artificial Sequence: Synthetic peptide
VARGIAARSRTSYLDY

SEQ ID NO: 1586 - protein, 16 aa, Artificial Sequence
  Description of Artificial Sequence: Synthetic peptide
VARGIAARSRTSYFDY

SEQ ID NO: 1587 - protein, 16 aa, Artificial Sequence
  Description of Artificial Sequence: Synthetic peptide
VARGIAARSRTRYFDQ

SEQ ID NO: 1588 - protein, 16 aa, Artificial Sequence
  Description of Artificial Sequence: Synthetic peptide
VARGIAARSRTSYFDY

SEQ ID NO: 1589 - protein, 16 aa, Artificial Sequence
  Description of Artificial Sequence: Synthetic peptide
VARGIAARSRTSYFDQ

SEQ ID NO: 1590 - protein, 16 aa, Artificial Sequence
  Description of Artificial Sequence: Synthetic peptide
VARGIAARSRTILLDQ

SEQ ID NO: 1591 - protein, 16 aa, Artificial Sequence
  Description of Artificial Sequence: Synthetic peptide
VARGIAARSRTSFIDY

SEQ ID NO: 1592 - protein, 16 aa, Artificial Sequence
  Description of Artificial Sequence: Synthetic peptide
VARGIAARSRTSYFDY

SEQ ID NO: 1593 - protein, 16 aa, Artificial Sequence
  Description of Artificial Sequence: Synthetic peptide
VARGIAARSRTSYLDF

SEQ ID NO: 1594 - protein, 16 aa, Artificial Sequence
  Description of Artificial Sequence: Synthetic peptide
VARGIAARSRTRSFDY

SEQ ID NO: 1595 - protein, 16 aa, Artificial Sequence
  Description of Artificial Sequence: Synthetic peptide
VARGIAARSRTSYFNQ

SEQ ID NO: 1596 - protein, 16 aa, Artificial Sequence
  Description of Artificial Sequence: Synthetic peptide
VARGIAARSRTSFFDQ

SEQ ID NO: 1597 - protein, 16 aa, Artificial Sequence
  Description of Artificial Sequence: Synthetic peptide
VARGIAARSRTSYFDT

SEQ ID NO: 1598 - protein, 16 aa, Artificial Sequence
  Description of Artificial Sequence: Synthetic peptide
VARGIAARSRTSYFDY

SEQ ID NO: 1599 - protein, 16 aa, Artificial Sequence
  Description of Artificial Sequence: Synthetic peptide
VARGIAARSRTSYFDY

SEQ ID NO: 1600 - protein, 16 aa, Artificial Sequence
  Description of Artificial Sequence: Synthetic peptide
VARGIAARSRTRYIDQ

SEQ ID NO: 1601 - protein, 16 aa, Artificial Sequence
  Description of Artificial Sequence: Synthetic peptide
VARGIAARSRTSYFDY

SEQ ID NO: 1602 - protein, 16 aa, Artificial Sequence
  Description of Artificial Sequence: Synthetic peptide
VARGIAYRRRTSYFDY

SEQ ID NO: 1603 - protein, 16 aa, Artificial Sequence
  Description of Artificial Sequence: Synthetic peptide
VARGIADRSRTSYSDY

SEQ ID NO: 1604 - protein, 16 aa, Artificial Sequence
  Description of Artificial Sequence: Synthetic peptide
VARGIAARSRTSYFDY

SEQ ID NO: 1605 - protein, 16 aa, Artificial Sequence
  Description of Artificial Sequence: Synthetic peptide
VARGIAARSRTSYFDY

SEQ ID NO: 1606 - protein, 16 aa, Artificial Sequence
  Description of Artificial Sequence: Synthetic peptide
VARGIAARSRNSQQDY

SEQ ID NO: 1607 - protein, 16 aa, Artificial Sequence
  Description of Artificial Sequence: Synthetic peptide
VARGIAARSRTSYFDQ

SEQ ID NO: 1608 - protein, 16 aa, Artificial Sequence
  Description of Artificial Sequence: Synthetic peptide
VARGIAARSRTVYFDH

SEQ ID NO: 1609 - protein, 16 aa, Artificial Sequence
  Description of Artificial Sequence: Synthetic peptide
VARGIAARSRTSYFDY

SEQ ID NO: 1610 - protein, 16 aa, Artificial Sequence
  Description of Artificial Sequence: Synthetic peptide
VAQGIAARSRTTQFDY

SEQ ID NO: 1611 - protein, 16 aa, Artificial Sequence
  Description of Artificial Sequence: Synthetic peptide
VARGIAARSRTSYFDY

SEQ ID NO: 1612 - protein, 16 aa, Artificial Sequence
  Description of Artificial Sequence: Synthetic peptide
VGRGIAARSRTSFFDQ

SEQ ID NO: 1613 - protein, 16 aa, Artificial Sequence
  Description of Artificial Sequence: Synthetic peptide
VARGIAARSRTSYFDY

SEQ ID NO: 1614 - protein, 16 aa, Artificial Sequence
  Description of Artificial Sequence: Synthetic peptide
VARGIAARSRTSQFDH

SEQ ID NO: 1615 - protein, 16 aa, Artificial Sequence
  Description of Artificial Sequence: Synthetic peptide
VARGIAARSRTSYFDY

SEQ ID NO: 1616 - protein, 16 aa, Artificial Sequence
  Description of Artificial Sequence: Synthetic peptide
VARGIAARSRTSYFDY

SEQ ID NO: 1617 - protein, 16 aa, Artificial Sequence
  Description of Artificial Sequence: Synthetic peptide
VARGIAARSRTSYFDY

SEQ ID NO: 1618 - protein, 16 aa, Artificial Sequence
  Description of Artificial Sequence: Synthetic peptide
VARGIAARSRTINLDY

SEQ ID NO: 1619 - protein, 16 aa, Artificial Sequence
  Description of Artificial Sequence: Synthetic peptide
VARGIAARQRTSYYDY

SEQ ID NO: 1620 - protein, 16 aa, Artificial Sequence
  Description of Artificial Sequence: Synthetic peptide
VAQGISGRSRLSYVDY

SEQ ID NO: 1621 - protein, 16 aa, Artificial Sequence
  Description of Artificial Sequence: Synthetic peptide
VARGIAARSRTSQFDY

SEQ ID NO: 1622 - protein, 16 aa, Artificial Sequence
  Description of Artificial Sequence: Synthetic peptide
VARGITARSRTSYFDD

SEQ ID NO: 1623 - protein, 16 aa, Artificial Sequence
  Description of Artificial Sequence: Synthetic peptide
VARGIAARSRTSYFDY

SEQ ID NO: 1624 - protein, 16 aa, Artificial Sequence
  Description of Artificial Sequence: Synthetic peptide
VARGIAARSRTSYFDY

SEQ ID NO: 1625 - protein, 16 aa, Artificial Sequence
  Description of Artificial Sequence: Synthetic peptide
QARGIAARSRTSYFDY

SEQ ID NO: 1626 - protein, 16 aa, Artificial Sequence
  Description of Artificial Sequence: Synthetic peptide
VARGISARSRTSCFDY

SEQ ID NO: 1627 - protein, 16 aa, Artificial Sequence
  Description of Artificial Sequence: Synthetic peptide
VARGIAARSRTSYFDY

SEQ ID NO: 1628 - protein, 16 aa, Artificial Sequence
  Description of Artificial Sequence: Synthetic peptide
VGRGIAARSRTSYFDK

SEQ ID NO: 1629 - protein, 16 aa, Artificial Sequence
  Description of Artificial Sequence: Synthetic peptide
VARGIAARSRTSYFDY

SEQ ID NO: 1630 - protein, 16 aa, Artificial Sequence
  Description of Artificial Sequence: Synthetic peptide
VARGIAARSRTSYFDY

SEQ ID NO: 1631 - protein, 16 aa, Artificial Sequence
  Description of Artificial Sequence: Synthetic peptide
VARGIAARSRTSYFDY

SEQ ID NO: 1632 - protein, 16 aa, Artificial Sequence
  Description of Artificial Sequence: Synthetic peptide
VARGIVARSRTSNFDQ

SEQ ID NO: 1633 - protein, 16 aa, Artificial Sequence
  Description of Artificial Sequence: Synthetic peptide
LARGIAARSRTSYQDI

SEQ ID NO: 1634 - protein, 16 aa, Artificial Sequence
  Description of Artificial Sequence: Synthetic peptide
VARGIAARSRTSYFDY

SEQ ID NO: 1635 - protein, 109 aa, Artificial Sequence; identical to SEQ ID NO: 601
  Description of Artificial Sequence: Synthetic polypeptide

SEQ ID NO: 1636 - protein, 142 aa, Artificial Sequence
  Description of Artificial Sequence: Synthetic polypeptide
EVQLLESGGGLVQPGGSLRLSCAASGFTFSNYLMAWVRQAPGKGLEWVSWIVPSGGYTEYADSVKGRFTISRDNSKNTLYLQMNSLRAEDTAVYYCARVARGIAARSRTSYFDYWGQGTLVTVSSASTKGPSVFPLAPSSKS

SEQ ID NO: 1637 - protein, 109 aa, Artificial Sequence; identical to SEQ ID NO: 601
  Description of Artificial Sequence: Synthetic polypeptide

SEQ ID NO: 1638 - protein, 142 aa, Artificial Sequence
  Description of Artificial Sequence: Synthetic polypeptide
EVQLLESGGGLVQPGGSLRLSCAASGFTFSVYMMIWVRQAPGKGLEWVSSISPSGGQTTYADSVKGRFTISRDNSKNTLYLQMNSLRAEDTAVYYCARVARGIAARSRTSYFDYWGQGTLVTVSSASTKGPSVFPLAPSSKS

SEQ ID NO: 1639 - protein, 109 aa, Artificial Sequence; identical to SEQ ID NO: 601
  Description of Artificial Sequence: Synthetic polypeptide

SEQ ID NO: 1640 - protein, 142 aa, Artificial Sequence
  Description of Artificial Sequence: Synthetic polypeptide
EVQLLESGGGLVQPGGSLRLSCAASGFTFSDYMMTWVRQAPGKGLQWVSYISPSGGLTSYADSVKGRFTISRDNSKNTLYLQMNSLRAEDTAVYYCARVARGIAARSRTSYFDYWGQGTLVTVSSASTKGPSVFPLAPSSKS

SEQ ID NO: 1641 - protein, 109 aa, Artificial Sequence; identical to SEQ ID NO: 601
  Description of Artificial Sequence: Synthetic polypeptide

SEQ ID NO: 1642 - protein, 142 aa, Artificial Sequence
  Description of Artificial Sequence: Synthetic polypeptide
EVQLLESGGGLVQPGGSLRLSCAASGFTFSTYMMQWVRQAPGKGLEWVSYIGPSGGKTDYADSVKGRFTISRDNSKNTLYLQMNSLRAEDTAVYYCARVARGIAARSRTSYFDYWGQGTLVTVSSASTKGPSVFPLAPSSKS

SEQ ID NO: 1643 - protein, 109 aa, Artificial Sequence; identical to SEQ ID NO: 601
  Description of Artificial Sequence: Synthetic polypeptide

SEQ ID NO: 1644 - protein, 142 aa, Artificial Sequence
  Description of Artificial Sequence: Synthetic polypeptide
EVQLLESGGGLVQPGGSLRLSCAASGFTFSTYLMAWVRQAPGKGLEWVSGIVSSGGRTLYADSVKGRFTISRDNSKNTLYLQMNSLRAEDTAVYYCARVARGIAARSRTSYFDYWGQGTLVTVSSASTKGPSVFPLAPSSKS

SEQ ID NO: 1645 - protein, 109 aa, Artificial Sequence; identical to SEQ ID NO: 601
  Description of Artificial Sequence: Synthetic polypeptide

SEQ ID NO: 1646 - protein, 142 aa, Artificial Sequence
  Description of Artificial Sequence: Synthetic polypeptide
EVQLLESGGGLVQPGGSLRLSCAASGFTFSQYDMIWVRQAPGKGLEWVSYISSSGGFTRYADSVKGRFTISRDNSKNTLYLQMNSLRAEDTAVYYCARVARGIAARSRTSYFDYWGQGTLVTVSSASTKGPSVFPLAPSSKS

SEQ ID NO: 1647 - protein, 109 aa, Artificial Sequence; identical to SEQ ID NO: 601
  Description of Artificial Sequence: Synthetic polypeptide

SEQ ID NO: 1648 - protein, 142 aa, Artificial Sequence
  Description of Artificial Sequence: Synthetic polypeptide
EVQLLESGGGLVQPGGSLRLSCAASGFTFSNYDMIWVRQAPGKGLEWVSSISSSGGTTKYADSVKGRFTISRDNSKNTLYLQMNSLRAEDTAVYYCARVARGIAARSRTSYFDYWGQGTLVTVSSASTKGPSVFPLAPSSKS

SEQ ID NO: 1649 - protein, 109 aa, Artificial Sequence; identical to SEQ ID NO: 601
  Description of Artificial Sequence: Synthetic polypeptide

SEQ ID NO: 1650 - protein, 142 aa, Artificial Sequence
  Description of Artificial Sequence: Synthetic polypeptide
EVQLLESGGGLVQPGGSLRLSCAASGFTFSQYMMMWVRQAPGKGLEWVSRISPSGGSTLYADSVKGRFTISRDNSKNTLYLQMNSLRAEDTAVYYCARVARGIAARSRTSYFDYWGQGTLVTVSSASTKGPSVFPLAPSSKS

SEQ ID NO: 1651 - protein, 109 aa, Artificial Sequence; identical to SEQ ID NO: 601
  Description of Artificial Sequence: Synthetic polypeptide

SEQ ID NO: 1652 - protein, 142 aa, Artificial Sequence
  Description of Artificial Sequence: Synthetic polypeptide
EVQLLESGGGLVQPGGSLRLSCAASGFTFSTYKMQWVRQAPGKGLEWVSSISPSGGPTNYADSVKGRFTISRDNSKNTLYLQMNSLRAEDTAVYYCARVARGIAARSRTSYFDYWGQGTLVTVSSASTKGPSVFPLAPSSKS

SEQ ID NO: 1653 - protein, 109 aa, Artificial Sequence; identical to SEQ ID NO: 601
  Description of Artificial Sequence: Synthetic polypeptide

SEQ ID NO: 1654 - protein, 142 aa, Artificial Sequence
  Description of Artificial Sequence: Synthetic polypeptide
EVQLLESGGGLVQPGGSLRLSCAASGFTFSNYTMGWVRQAPGKGLEWVSSISPSGGKTDYADSVKGRFTISRDNSKNTLYLQMNSLRAEDTAVYYCARVARGIAARSRTSYFDYWGQGTLVTVSSASTKGPSVFPLAPSSKS

SEQ ID NO: 1655 - protein, 109 aa, Artificial Sequence; identical to SEQ ID NO: 601
  Description of Artificial Sequence: Synthetic polypeptide

SEQ ID NO: 1656 - protein, 142 aa, Artificial Sequence
  Description of Artificial Sequence: Synthetic polypeptide
EVQLLESGGGLVQPGGSLRLSCAASGFTFSSQQMVWVRQAPGKGLEWVSYISPSGGNTYYADSVKGRFTISRDNSKNTLYLQMNSLRAEDTAVYYCARVARGIAARSRTSYFDYWGQGTLVTVSSASTKGPSVFPLAPSSKS

SEQ ID NO: 1657 - protein, 109 aa, Artificial Sequence; identical to SEQ ID NO: 601
  Description of Artificial Sequence: Synthetic polypeptide

SEQ ID NO: 1658 - protein, 142 aa, Artificial Sequence
  Description of Artificial Sequence: Synthetic polypeptide
EVQLLESGGGLVQPGGSLRLSCAASGFTFSNYTMQWVRQAPGKGLQWVSYISPSGGYTGYADSVKGRFTISRDNSKNTLYLQMNSLRAEDTAVYYCARVARGIAARSRTSYFDYWGQGTLVTVSSASTKGPSVFPLAPSSKS

SEQ ID NO: 1659 - protein, 109 aa, Artificial Sequence; identical to SEQ ID NO: 601
  Description of Artificial Sequence: Synthetic polypeptide

SEQ ID NO: 1660 - protein, 142 aa, Artificial Sequence
  Description of Artificial Sequence: Synthetic polypeptide
EVQLLESGGGLVQPGGSLRLSCAASGFTFSDYMMMWVRQAPGKGLEWVSSIVPSGGHTQYADSVKGRFTISRDNSKNTLYLQMNSLRAEDTAVYYCARVARGIAARSRTSYFDYWGQGTLVTVSSASTKGPSVFPLAPSSKS

SEQ ID NO: 1661 - protein, 109 aa, Artificial Sequence; identical to SEQ ID NO: 601
  Description of Artificial Sequence: Synthetic polypeptide

SEQ ID NO: 1662 - protein, 142 aa, Artificial Sequence
  Description of Artificial Sequence: Synthetic polypeptide
EVQLLESGGGLVQPGGSLRLSCAASGFTFSNYMMGWVRQAPGKGLQWVSSISPSGGLTKYADSVKGRFTISRDNSKNTLYLQMNSLRAEDTAVYYCARVARGIAARSRTSYFDYWGQGTLVTVSSASTKGPSVFPLAPSSKS

SEQ ID NO: 1663 - protein, 109 aa, Artificial Sequence; identical to SEQ ID NO: 601
  Description of Artificial Sequence: Synthetic polypeptide

SEQ ID NO: 1664 - protein, 142 aa, Artificial Sequence
  Description of Artificial Sequence: Synthetic polypeptide
EVQLLESGGGLVQPGGSLRLSCAASGFTFSQYLMAWVRQAPGKGLEWVSSIYPSGGWTKYADSVKGRFTISRDNSKNTLYLQMNSLRAEDTAVYYCARVARGIAARSRTSYFDYWGQGTLVTVSSASTKGPSVFPLAPSSKS

SEQ ID NO: 1665 - protein, 109 aa, Artificial Sequence; identical to SEQ ID NO: 601
  Description of Artificial Sequence: Synthetic polypeptide

SEQ ID NO: 1666 - protein, 142 aa, Artificial Sequence
  Description of Artificial Sequence: Synthetic polypeptide
EVQLLESGGGLVQPGGSLRLSCAASGFTFSQYMMVWVRQAPGKGLEWVSSIYSSGGNTPYADSVKGRFTISRDNSKNTLYLQMNSLRAEDTAVYYCARVARGIAARSRTSYFDYWGQGTLVTVSSASTKGPSVFPLAPSSKS

SEQ ID NO: 1667 - protein, 109 aa, Artificial Sequence; identical to SEQ ID NO: 601
  Description of Artificial Sequence: Synthetic polypeptide

SEQ ID NO: 1668 - protein, 142 aa, Artificial Sequence
  Description of Artificial Sequence: Synthetic polypeptide
EVQLLESGGGLVQPGGSLRLSCAASGFTFSEYMMMWVRQAPGKGLEWVSVISPSGGQTHYADSVKGRFTISRDNSKNTLYLQMNSLRAEDTAVYYCARVARGIAARSRTSYFDYWGQGTLVTVSSASTKGPSVFPLAPSSKS

SEQ ID NO: 1669 - protein, 109 aa, Artificial Sequence; identical to SEQ ID NO: 601
  Description of Artificial Sequence: Synthetic polypeptide

SEQ ID NO: 1670 - protein, 142 aa, Artificial Sequence
  Description of Artificial Sequence: Synthetic polypeptide
EVQLLESGGGLVQPGGSLRLSCAASGFTFSGYMMVWVRQAPGKGLEWVSRISPSGGPTIYADSVKGRFTISRDNSKNTLYLQMNSLRAEDTAVYYCARVARGIAARSRTSYFDYWGQGTLVTVSSASTKGPSVFPLAPSSKS

SEQ ID NO: 1671 - protein, 109 aa, Artificial Sequence; identical to SEQ ID NO: 601
  Description of Artificial Sequence: Synthetic polypeptide

SEQ ID NO: 1672 - protein, 142 aa, Artificial Sequence
  Description of Artificial Sequence: Synthetic polypeptide
EVQLLESGGGLVQPGGSLRLSCAASGFTFSVYMMSWVRQAPGKGLEWVSSIVPSGGSTTYADSVKGRFTISRDNSKNTLYLQMNSLRAEDTAVYYCARVARGIAARSRTSYFDYWGQGTLVTVSSASTKGPSVFPLAPSSKS

SEQ ID NO: 1673 - protein, 109 aa, Artificial Sequence; identical to SEQ ID NO: 601
  Description of Artificial Sequence: Synthetic polypeptide

SEQ ID NO: 1674 - protein, 142 aa, Artificial Sequence
  Description of Artificial Sequence: Synthetic polypeptide
EVQLLESGGGLVQPGGSLRLSCAASGFTFSEYMMVWVRQAPGKGLEWVSRISPSGGTTEYADSVKGRFTISRDNSKNTLYLQMNSLRAEDTAVYYCARVARGIAARSRTSYFDYWGQGTLVTVSSASTKGPSVFPLAPSSKS

SEQ ID NO: 1675 - protein, 109 aa, Artificial Sequence; identical to SEQ ID NO: 601
  Description of Artificial Sequence: Synthetic polypeptide

SEQ ID NO: 1676 - protein, 142 aa, Artificial Sequence
  Description of Artificial Sequence: Synthetic polypeptide
EVQLLESGGGLVQPGGSLRLSCAASGFTFSSYMMVWVRQAPGKGLEWVSSISPSGGYTIQADSVKGRFTISRDNSKNTLYLQMNSLRAEDTAVYYCARVARGIAARSRTSYFDYWGQGTLVTVSSASTKGPSVFPLAPSSKS

SEQ ID NO: 1677 - protein, 109 aa, Artificial Sequence; identical to SEQ ID NO: 601
  Description of Artificial Sequence: Synthetic polypeptide

SEQ ID NO: 1678 - protein, 142 aa, Artificial Sequence
  Description of Artificial Sequence: Synthetic polypeptide
EVQLLESGGGLVQPGGSLRLSCAASGFTFSGYKMQWVRQAPGKGLEWVSSISPSGGITMYADSVKGRFTISRDNSKNTLYLQMNSLRAEDTAVYYCARVARGIAARSRTSYFDYWGQGTLVTVSSASTKGPSVFPLAPSSKS

SEQ ID NO: 1679 - protein, 109 aa, Artificial Sequence; identical to SEQ ID NO: 601
  Description of Artificial Sequence: Synthetic polypeptide

SEQ ID NO: 1680 - protein, 142 aa, Artificial Sequence
  Description of Artificial Sequence: Synthetic polypeptide
EVQLLESGGGLVQPGGSLRLSCAASGFTFSDYMMAWVRQAPGKGLEWVSSIVPSGGHTHYADSVKGRFTISRDNSKNTLYLQMNSLRAEDTAVYYCARVARGIAARSRTSYFDYWGQGTLVTVSSASTKGPSVFPLAPSSKS

SEQ ID NO: 1681 - protein, 109 aa, Artificial Sequence; identical to SEQ ID NO: 601
  Description of Artificial Sequence: Synthetic polypeptide

SEQ ID NO: 1682 - protein, 142 aa, Artificial Sequence
  Description of Artificial Sequence: Synthetic polypeptide
EVQLLESGGGLVQPGGSLRLSCAASGFTFSHYLMTWVRQAPGKGLEWVSYISPSGGHTIYADSVKGRFTISRDNSKNTLYLQMNSLRAEDTAVYYCARVARGISARSRTSCFDYWGQGTLVTVSSASTKGPSVFPLAPSSKS

SEQ ID NO: 1683 - protein, 109 aa, Artificial Sequence; identical to SEQ ID NO: 601
  Description of Artificial Sequence: Synthetic polypeptide

SEQ ID NO: 1684 - protein, 142 aa, Artificial Sequence
  Description of Artificial Sequence: Synthetic polypeptide
EVQLLESGGGLVQPGGSLRLSCAASGFTFSHYLMTWVRQAPGKGLEWVSYISPSGGHTIYADSVKGRFTISRDNSKNTLYLQMNSLRAEDTALYYCARVARGIAARSRTINLDYWGQGTLVTVSSASTKGPSVFPLAPSSKS

SEQ ID NO: 1685 - protein, 109 aa, Artificial Sequence; identical to SEQ ID NO: 601
  Description of Artificial Sequence: Synthetic polypeptide

SEQ ID NO: 1686 - protein, 142 aa, Artificial Sequence
  Description of Artificial Sequence: Synthetic polypeptide
EVQLLESGGGLVQPGGSLRLSCAASGFTFSHYLMTWVRQAPGKGLEWVSYISPSGGHTIYADSVKGRFTISRDNSKNTLYLQMNSLRAEDTAVYYCARVARGIAARSRTRSFDYWGQGTLVTVSSASTKGPSVFPLAPSSKS

SEQ ID NO: 1687 - protein, 109 aa, Artificial Sequence; identical to SEQ ID NO: 601
  Description of Artificial Sequence: Synthetic polypeptide

SEQ ID NO: 1688 - protein, 142 aa, Artificial Sequence
  Description of Artificial Sequence: Synthetic polypeptide
EVQLLESGGGLVQPGGSLRLSCAASGFTFSHYLMTWVRQAPGKGLEWVSYISPSGGHTIYADSVKGRFTISRDNSKNTLYLQMNSLRAEDTAVYYCARVGRGIAARSRTSYFDKWGQGTLVTVSSASTKGPSVFPLAPSSKS

SEQ ID NO: 1689 - protein, 109 aa, Artificial Sequence; identical to SEQ ID NO: 601
  Description of Artificial Sequence: Synthetic polypeptide

SEQ ID NO: 1690 - protein, 142 aa, Artificial Sequence
  Description of Artificial Sequence: Synthetic polypeptide
EVQLLESGGGLVQPGGSLRLSCAASGFTFSHYLMTWVRQAPGKGLEWVSYISPSGGHTIYADSVKGRFTISRDNSKNTLYLQMNSLRAEDTAVYYCARVARGIAARSRTSQFDHWGQGTLVTVSSASTKGPSVFPLAPSSKS

SEQ ID NO: 1691 - protein, 109 aa, Artificial Sequence; identical to SEQ ID NO: 601
  Description of Artificial Sequence: Synthetic polypeptide

SEQ ID NO: 1692 - protein, 142 aa, Artificial Sequence
  Description of Artificial Sequence: Synthetic polypeptide
EVQLLESGGGLVQPGGSLRLSCAASGFTFSHYLMTWVRQAPGKGLEWVSYISPSGGHTIYADSVKGRFTISRDNSKNTLYLQMNSLRAEDTAVYYCARVARGIAARSRTSFFDQWGQGTLVTVSSASTKGPSVFPLAPSSKS

SEQ ID NO: 1693 - protein, 109 aa, Artificial Sequence; identical to SEQ ID NO: 601
  Description of Artificial Sequence: Synthetic polypeptide

SEQ ID NO: 1694 - protein, 142 aa, Artificial Sequence
  Description of Artificial Sequence: Synthetic polypeptide
EVQLLESGGGLVQPGGSLRLSCAASGFTFSHYLMTWVRQAPGKGLEWVSYISPSGGHTIYADSVKGRFTISRDNSKNTLYLQMNSLRAEDTAVYYCARVARGIAARSRTSFIDYWGQGTLVTVSSASTKGPSVFPLAPSSKS

SEQ ID NO: 1695 - protein, 109 aa, Artificial Sequence; identical to SEQ ID NO: 601
  Description of Artificial Sequence: Synthetic polypeptide

SEQ ID NO: 1696 - protein, 142 aa, Artificial Sequence
  Description of Artificial Sequence: Synthetic polypeptide
EVQLLESGGGLVQPGGSLRLSCAASGFTFSHYLMTWVRQAPGKGLEWVSYISPSGGHTIYADSVKGRFTISRDNSKNTLYLQMNSLRAEDTAVYYCARLARGIAARSRTSYQDIWGQGTLVTVSSASTKGPSVFPLAPSSKS

SEQ ID NO: 1697 - protein, 109 aa, Artificial Sequence; identical to SEQ ID NO: 601
  Description of Artificial Sequence: Synthetic polypeptide

SEQ ID NO: 1698 - protein, 142 aa, Artificial Sequence
  Description of Artificial Sequence: Synthetic polypeptide
EVQLLESGGGLVQPGGSLRLSCAASGFTFSHYLMTWVRQAPGKGLEWVSYISPSGGHTIYADSVKGRFTISRDNSKNTLYLQMNSLRAEDTAVYYCARVAQGISARSRTSYFDYWGQGTLVTVSSASTKGPSVFPLAPSSKS

SEQ ID NO: 1699 - protein, 109 aa, Artificial Sequence; identical to SEQ ID NO: 601
  Description of Artificial Sequence: Synthetic polypeptide

SEQ ID NO: 1700 - protein, 142 aa, Artificial Sequence
  Description of Artificial Sequence: Synthetic polypeptide
EVQLLESGGGLVQPGGSLRLSCAASGFTFSHYLMTWVRQAPGKGLEWVSYISPSGGHTIYADSVKGRFTISRDNSKNTLYLQMNSLRAEDTAVYYCARVARGIAARSRTSFFDYWGQGTLVTVSSASTKGPSVFPLAPSSKS

SEQ ID NO: 1701 - protein, 109 aa, Artificial Sequence; identical to SEQ ID NO: 601
  Description of Artificial Sequence: Synthetic polypeptide

SEQ ID NO: 1702 - protein, 142 aa, Artificial Sequence
  Description of Artificial Sequence: Synthetic polypeptide
EVQLLESGGGLVQPGGSLRLSCAASGFTFSHYLMTWVRQAPGKGLEWVSYISPSGGHTIYADSVKGRFTISRDNSKNTLYLQMNSLRAEDTAVYYCARVARGIAARSRTSYFDQWGQGTLVTVSSASTKGPSVFPLAPSSKS

SEQ ID NO: 1703 - protein, 109 aa, Artificial Sequence; identical to SEQ ID NO: 601
  Description of Artificial Sequence: Synthetic polypeptide

SEQ ID NO: 1704 - protein, 142 aa, Artificial Sequence
  Description of Artificial Sequence: Synthetic polypeptide
EVQLLESGGGLVQPGGSLRLSCAASGFTFSHYLMTWVRQAPGKGLEWVSYISPSGGHTIYADSVKGRFTISRDNSKNTLYLQMNSLRAEDTAVYYCARVARGIADRSRTSYSDYWGQGTLVTVSSASTKGPSVFPLAPSSKS

SEQ ID NO: 1705 - protein, 109 aa, Artificial Sequence; identical to SEQ ID NO: 601
  Description of Artificial Sequence: Synthetic polypeptide

SEQ ID NO: 1706 - protein, 142 aa, Artificial Sequence
  Description of Artificial Sequence: Synthetic polypeptide
EVQLLESGGGLVQPGGSLRLSCAASGFTFSHYLMTWVRQAPGKGLEWVSYISPSGGHTIYADSVKGRFTISRDNSKNTLYLQMNSLRAEDTAVYYCARVARGIAARSRTSYLDYWGQGTLVTVSSASTKGPSVFPLAPSSKS

SEQ ID NO: 1707 - protein, 109 aa, Artificial Sequence; identical to SEQ ID NO: 601
  Description of Artificial Sequence: Synthetic polypeptide

SEQ ID NO: 1708 - protein, 142 aa, Artificial Sequence
  Description of Artificial Sequence: Synthetic polypeptide
EVQLLESGGGLVQPGGSLRLSCAASGFTFSHYLMTWVRQAPGKGLEWVSYISPSGGHTIYADSVKGRFTISRDNSKNTLYLQMNSLRAEDTAVYYCARVARGIASRSRTRYCDYWGQGTLVTVSSASTKGPSVFPLAPSSKS

SEQ ID NO: 1709 - protein, 109 aa, Artificial Sequence; identical to SEQ ID NO: 601
  Description of Artificial Sequence: Synthetic polypeptide

SEQ ID NO: 1710 - protein, 142 aa, Artificial Sequence
  Description of Artificial Sequence: Synthetic polypeptide
EVQLLESGGGLVQPGGSLRLSCAASGFTFSHYLMTWVRQAPGKGLEWVSYISPSGGHTIYADSVKGRFTISRDNSKNTLYLQMNSLRAEDTAVYYCARVARGIVARSRTSNFDQWGQGTLVTVSSASTKGPSVFPLAPSSKS

SEQ ID NO: 1711 - protein, 109 aa, Artificial Sequence; identical to SEQ ID NO: 601
  Description of Artificial Sequence: Synthetic polypeptide

SEQ ID NO: 1712 - protein, 142 aa, Artificial Sequence
  Description of Artificial Sequence: Synthetic polypeptide
EVQLLESGGGLVQPGGSLRLSCAASGFTFSHYLMTWVRQAPGKGLEWVSYISPSGGHTIYADSVKGRFTISRDNSKNTLYLQMNSLRAEDTAVYYCARVAQGIVARSRTSYLHQWGQGTLVTVSSASTKGPSVFPLAPSSKS

SEQ ID NO: 1713 - protein, 109 aa, Artificial Sequence; identical to SEQ ID NO: 601
  Description of Artificial Sequence: Synthetic polypeptide

SEQ ID NO: 1714 - protein, 142 aa, Artificial Sequence
  Description of Artificial Sequence: Synthetic polypeptide
EVQLLESGGGLVQPGGSLRLSCAASGFTFSHYLMTWVRQAPGKGLEWVSYISPSGGHTIYADSVKGRFTISRDNSKNTLYLQMNSLRAEDTAVYYCARVARGIAARSRTRYIDQWGQGTLVTVSSASTKGPSVFPLAPSSKS

SEQ ID NO: 1715 - protein, 109 aa, Artificial Sequence; identical to SEQ ID NO: 601
  Description of Artificial Sequence: Synthetic polypeptide

SEQ ID NO: 1716 - protein, 142 aa, Artificial Sequence
  Description of Artificial Sequence: Synthetic polypeptide
EVQLLESGGGLVQPGGSLRLSCAASGFTFSHYLMTWVRQAPGKGLEWVSYISPSGGHTIYADSVKGRFTISRDNSKNTLYLQMNSLRAEDTAVYYCARVARGIAYRRRTSYFDYWGQGTLVTVSSASTKGPSVFPLAPSSKS

SEQ ID NO: 1717 - protein, 109 aa, Artificial Sequence; identical to SEQ ID NO: 601
  Description of Artificial Sequence: Synthetic polypeptide

SEQ ID NO: 1718 - protein, 142 aa, Artificial Sequence
  Description of Artificial Sequence: Synthetic polypeptide
EVQLLESGGGLVQPGGSLRLSCAASGFTFSHYLMTWVRQAPGKGLEWVSYISPSGGHTIYADSVKGRFTISRDNSKNTLYLQMNSLRAEDTAVYYCAMVGQGIRGRSRTSYFAQWGQGTLVTVSSASTKGPSVFPLAPSSKS

SEQ ID NO: 1719 - protein, 109 aa, Artificial Sequence; identical to SEQ ID NO: 601
  Description of Artificial Sequence: Synthetic polypeptide

SEQ ID NO: 1720 - protein, 142 aa, Artificial Sequence
  Description of Artificial Sequence: Synthetic polypeptide
EVQLLESGGGLVQPGGSLRLSCAASGFTFSHYLMTWVRQAPGKGLEWVSYISPSGGHTIYADSVKGRFTISRDNSKNTLYLQMNSLRAEDTAVYYCARVGRGIAARSRTSQLDYWGQGTLVTVSSASTKGPSVFPLAPSSKS

SEQ ID NO: 1721 - protein, 109 aa, Artificial Sequence; identical to SEQ ID NO: 601
  Description of Artificial Sequence: Synthetic polypeptide

SEQ ID NO: 1722 - protein, 142 aa, Artificial Sequence
  Description of Artificial Sequence: Synthetic polypeptide
EVQLLESGGGLVQPGGSLRLSCAASGFTFSHYLMTWVRQAPGKGLEWVSYISPSGGHTIYADSVKGRFTISRDNSKNTLYLQMNSLRAEDTAVYYCARVARGITARSRTSYFDDWGQGTLVTVSSASTKGPSVFPLAPSSKS

SEQ ID NO: 1723 - protein, 109 aa, Artificial Sequence; identical to SEQ ID NO: 601
  Description of Artificial Sequence: Synthetic polypeptide

SEQ ID NO: 1724 - protein, 142 aa, Artificial Sequence
  Description of Artificial Sequence: Synthetic polypeptide
EVQLLESGGGLVQPGGSLRLSCAASGFTFSHYLMTWVRQAPGKGLEWVSYISPSGGHTIYADSVKGRFTISRDNSKNTLYLQMNSLRAEDTAVYYCARVGRGIAARSRTSFFDQWGQGTLVTVSSASTKGPSVFPLAPSSKS

SEQ ID NO: 1725 - protein, 109 aa, Artificial Sequence; identical to SEQ ID NO: 601
  Description of Artificial Sequence: Synthetic polypeptide

SEQ ID NO: 1726 - protein, 142 aa, Artificial Sequence
  Description of Artificial Sequence: Synthetic polypeptide
EVQLLESGGGLVQPGGSLRLSCAASGFTFSHYLMTWVRQAPGKGLEWVSYISPSGGHTIYADSVKGRFTISRDNSKNTLYLQMNSLRAEDTAVYYCATVARGIAARSRTSYFDQWGQGTLVTVSSASTKGPSVFPLAPSSKS

SEQ ID NO: 1727 - protein, 109 aa, Artificial Sequence; identical to SEQ ID NO: 601
  Description of Artificial Sequence: Synthetic polypeptide

SEQ ID NO: 1728 - protein, 142 aa, Artificial Sequence
  Description of Artificial Sequence: Synthetic polypeptide
EVQLLESGGGLVQPGGSLRLSCAASGFTFSHYLMTWVRQAPGKGLEWVSYISPSGGHTIYADSVKGRFTISRDNSKNTLYLQMNSLRAEDTAVYYCARVARGIAARSRTILLDQWGQGTLVTVSSASTKGPSVFPLAPSSKS

SEQ ID NO: 1729 - protein, 109 aa, Artificial Sequence; identical to SEQ ID NO: 601
  Description of Artificial Sequence: Synthetic polypeptide

SEQ ID NO: 1730 - protein, 142 aa, Artificial Sequence
  Description of Artificial Sequence: Synthetic polypeptide
EVQLLESGGGLVQPGGSLRLSCAASGFTFSHYLMTWVRQAPGKGLEWVSYISPSGGHTIYADSVKGRFTISRDNSKNTLYLQMNSLRAEDTAVYYCARQARGIAARSRTSYFDYWGQGTLVTVSSASTKGPSVFPLAPSSKS

SEQ ID NO: 1731 - protein, 109 aa, Artificial Sequence; identical to SEQ ID NO: 601
  Description of Artificial Sequence: Synthetic polypeptide

SEQ ID NO: 1732 - protein, 142 aa, Artificial Sequence
  Description of Artificial Sequence: Synthetic polypeptide
EVQLLESGGGLVQPGGSLRLSCAASGFTFSHYLMTWVRQAPGKGLEWVSYISPSGGHTIYADSVKGRFTISRDNSKNTLYLQMNSLRAEDTAVYYCARVARGIAARSRTSYLDQWSQGTLVTVSSASTKGPSVFPLAPSSKS

SEQ ID NO: 1733 - protein, 109 aa, Artificial Sequence; identical to SEQ ID NO: 601
  Description of Artificial Sequence: Synthetic polypeptide

SEQ ID NO: 1734 - protein, 142 aa, Artificial Sequence
  Description of Artificial Sequence: Synthetic polypeptide
EVQLLESGGGLVQPGGSLRLSCAASGFTFSHYLMTWVRQAPGKGLEWVSYISPSGGHTIYADSVKGRFTISRDNSKNTLYLQMNSLRAEDTAVYYCARVAQGISGRSRLSYVDYWGQGTLVTVSSASTKGPSVFPLAPSSKS

SEQ ID NO: 1735 - protein, 109 aa, Artificial Sequence; identical to SEQ ID NO: 601
  Description of Artificial Sequence: Synthetic polypeptide

SEQ ID NO: 1736 - protein, 142 aa, Artificial Sequence
  Description of Artificial Sequence: Synthetic polypeptide
EVQLLESGGGLVQPGGSLRLSCAASGFTFSHYLMTWVRQAPGKGLEWVSYISPSGGHTIYADSVKGRFTISRDNSKNTLYLQMNSLRAEDTAVYYCARVARGIAARSRTSYFDTWGQGTLVTVSSASTKGPSVFPLAPSSKS

SEQ ID NO: 1737 - protein, 109 aa, Artificial Sequence; identical to SEQ ID NO: 601
  Description of Artificial Sequence: Synthetic polypeptide

SEQ ID NO: 1738 - protein, 142 aa, Artificial Sequence
  Description of Artificial Sequence: Synthetic polypeptide
EVQLLESGGGLVQPGGSLRLSCAASGFTFSHYLMTWVRQAPGKGLEWVSYISPSGGHTIYADSVKGRFTISRDNSKNTLYLQMNSLRAEDTAVYYCARVAQGIAARSRTTQFDYWGQGTLVTVSSASTKGPSVFPLAPSSKS

SEQ ID NO: 1739 - protein, 109 aa, Artificial Sequence; identical to SEQ ID NO: 601
  Description of Artificial Sequence: Synthetic polypeptide

SEQ ID NO: 1740 - protein, 142 aa, Artificial Sequence
  Description of Artificial Sequence: Synthetic polypeptide
EVQLLESGGGLVQPGGSLRLSCAASGFTFSHYLMTWVRQAPGKGLEWVSYISPSGGHTIYADSVKGRFTISRDNSKNTLYLQMNSLRAEDTAVYYCARVARGIAARQRTSYYDYWGQGTLVTVSSASTKGPSVFPLAPSSKS

SEQ ID NO: 1741 - protein, 109 aa, Artificial Sequence; identical to SEQ ID NO: 601
  Description of Artificial Sequence: Synthetic polypeptide

SEQ ID NO: 1742 - protein, 142 aa, Artificial Sequence
  Description of Artificial Sequence: Synthetic polypeptide
EVQLLESGGGLVQPGGSLRLSCAASGFTFSHYLMTWVRQAPGKGLEWVSYISPSGGHTIYADSVKGRFTISRDNSKNTLYLQMNSLRAEDTAVYYCARVARGIAARSRTVYFDHWGQGTLVTVSSASTKGPSVFPLAPSSKS

SEQ ID NO: 1743 - protein, 109 aa, Artificial Sequence; identical to SEQ ID NO: 601
  Description of Artificial Sequence: Synthetic polypeptide

SEQ ID NO: 1744 - protein, 142 aa, Artificial Sequence
  Description of Artificial Sequence: Synthetic polypeptide
EVQLLESGGGLVQPGGSLRLSCAASGFTFSHYLMTWVRQAPGKGLEWVSYISPSGGHTIYADSVKGRFTISRDNSKNTLYLQMNSLRAEDTAVYYCARVARGIAARSRTSQFDYWGQGTLVTVSSASTKGPSVFPLAPSSKS

SEQ ID NO: 1745 - protein, 109 aa, Artificial Sequence; identical to SEQ ID NO: 601
  Description of Artificial Sequence: Synthetic polypeptide

SEQ ID NO: 1746 - protein, 142 aa, Artificial Sequence
  Description of Artificial Sequence: Synthetic polypeptide
EVQLLESGGGLVQPGGSLRLSCAASGFTFSHYLMTWVRQAPGKGLEWVSYISPSGGHTIYADSVKGRFTISRDNSKNTLYLQMNSLRAEDTAVYYCASVARGIAARSRTSYFNQWGQGTLVTVSSASTKGPSVFPLAPSSKS

SEQ ID NO: 1747 - protein, 109 aa, Artificial Sequence; identical to SEQ ID NO: 601
  Description of Artificial Sequence: Synthetic polypeptide

SEQ ID NO: 1748 - protein, 142 aa, Artificial Sequence
  Description of Artificial Sequence: Synthetic polypeptide
EVQLLESGGGLVQPGGSLRLSCAASGFTFSHYLMTWVRQAPGKGLEWVSYISPSGGHTIYADSVKGRFTISRDNSKNTLYLQMNSLRAEDTAVYYCARVAQGIAARSRTSSVDQWGQGTLVTVSSASTKGPSVFPLAPSSKS

SEQ ID NO: 1749 - protein, 109 aa, Artificial Sequence; identical to SEQ ID NO: 601
  Description of Artificial Sequence: Synthetic polypeptide

SEQ ID NO: 1750 - protein, 142 aa, Artificial Sequence
  Description of Artificial Sequence: Synthetic polypeptide
EVQLLESGGGLVQPGGSLRLSCAASGFTFSHYLMTWVRQAPGKGLEWVSYISPSGGHTIYADSVKGRFTISRDNSKNTLYLQMNSLRAEDTAVYYCARVATGIVARSRTRYFDQWGQGTLVTVSSASTKGPSVFPLAPSSKS

SEQ ID NO: 1751 - protein, 109 aa, Artificial Sequence; identical to SEQ ID NO: 601
  Description of Artificial Sequence: Synthetic polypeptide

SEQ ID NO: 1752 - protein, 142 aa, Artificial Sequence
  Description of Artificial Sequence: Synthetic polypeptide
EVQLLESGGGLVQPGGSLRLSCAASGFTFSHYLMTWVRQAPGKGLEWVSYISPSGGHTIYADSVKGRFTISRDNSKNTLYLQMNSLRAEDTAVYYCARVARGIAARSRTSYLDFWGQGTLVTVSSASTKGPSVFPLAPSSKS

SEQ ID NO: 1753 - protein, 109 aa, Artificial Sequence; identical to SEQ ID NO: 601
  Description of Artificial Sequence: Synthetic polypeptide

SEQ ID NO: 1754 - protein, 142 aa, Artificial Sequence
  Description of Artificial Sequence: Synthetic polypeptide
EVQLLESGGGLVQPGGSLRLSCAASGFTFSHYLMTWVRQAPGKGLEWVSYISPSGGHTIYADSVKGRFTISRDNSKNTLYLQMNSLRAEDTAVYYCARVARGIAARSRNSQQDYWGQGTLVTVSSASTKGPSVFPLAPSSKS

SEQ ID NO: 1755 - protein, 109 aa, Artificial Sequence; identical to SEQ ID NO: 601
  Description of Artificial Sequence: Synthetic polypeptide

SEQ ID NO: 1756 - protein, 142 aa, Artificial Sequence
  Description of Artificial Sequence: Synthetic polypeptide
EVQLLESGGGLVQPGGSLRLSCAASGFTFSHYLMTWVRQAPGKGLEWVSYISPSGGHTIYADSVKGRFTISRDNSKNTLYLQMNSLRAEDTAVYYCARVARGIAARSRTRYFDYWGQGTLVTVSSASTKGPSVFPLAPSSKS

SEQ ID NO: 1757 - protein, 109 aa, Artificial Sequence; identical to SEQ ID NO: 601
  Description of Artificial Sequence: Synthetic polypeptide

SEQ ID NO: 1758 - protein, 142 aa, Artificial Sequence
  Description of Artificial Sequence: Synthetic polypeptide
EVQLLESGGGLVQPGGSLRLSCAASGFTFSHYLMTWVRQAPGKGLEWVSYISPSGGHTIYADSVKGRFTISRDNSKNTLYLQMNSLRAEDTAVYYCARVARGIAARSRTRYFDQWGQGTLVTVSSASTKGPSVFPLAPSSKS

SEQ ID NO: 1759 - protein, 60 aa, Artificial Sequence; identical to SEQ ID NO: 61
  Description of Artificial Sequence: Synthetic polypeptide

SEQ ID NO: 1760 - protein, 58 aa, Artificial Sequence; identical to SEQ ID NO: 1
  Description of Artificial Sequence: Synthetic polypeptide
  MOD_RES (1)..(4): Any amino acid or absent
  MOD_RES (6)..(9): Any amino acid
  MOD_RES (10)..(10): Asp or Glu
  MOD_RES (11)..(11): Asp, Gly, Ser, Val, Asn, Ile, Ala or Thr
  MOD_RES (13)..(13): Arg, His, Pro, Asn, Ser, Thr, Ala, Gly, Lys or Gln
  MOD_RES (15)..(15): Ala, Lys, Ala, Ser, Gly, Met, Asn or Gln
  MOD_RES (16)..(16): Ala, Gly, Ser, Asp or Asn
  MOD_RES (17)..(17): Ala, Asn, Ser, Ile, Gly, Val, Gln or Thr
  MOD_RES (18)..(18): His, Leu, Gln or Ala
  MOD_RES (19)..(19): Pro, Gln, Leu, Asn or Ile
  MOD_RES (20)..(20): Any amino acid
  MOD_RES (21)..(21): Trp, Phe, Tyr, His or Ile
  MOD_RES (22)..(23): Tyr or Phe
  MOD_RES (24)..(29): Any amino acid
  MOD_RES (39)..(40): Any amino acid
  MOD_RES (31)..(31): Glu, Asp, Gln, Asn, Ser, Ala, Val, Leu, Ile or Thr
  MOD_RES (32)..(32): Glu, Gln, Asp, Asn, Pro, Thr, Leu, Ser, Ala, Gly and Val
  MOD_RES (34)..(34): Any amino acid
  MOD_RES (35)..(35): Tyr, Trp or Phe
  MOD_RES (39)..(39): Glu, Gly, Ala, Ser or Asp
  MOD_RES (40)..(40): Gly or Ala
  MOD_RES (41)..(42): Any amino acid
  MOD_RES (43)..(43): Asn or Gly
  MOD_RES (44)..(44): Any amino acid
  MOD_RES (45)..(45): Phe or Tyr
  MOD_RES (46)..(50): Any amino acid
  MOD_RES (52)..(54): Any amino acid
  MOD_RES (56)..(58): Any amino acid or absent

SEQ ID NO: 1761 - protein, 145 aa, Artificial Sequence
  Description of Artificial Sequence: Synthetic polypeptide
MRFPSIFTAVLFAASSALAAPVNTTTEDETAQIPAEAVIGYSDLEGDFDVAVLPFSNSTNNGLLFINTTIASIAAKEEGVSLEKREAMHSFCAFKADDGPCRAAHPRWFFNIFTRQCEEFIYGGCEGNQNRFESLEECKKMCTRD

SEQ ID NO: 1762 - DNA, 327 bp, Homo sapiens
caagacatccagatgacccagtctccaggcaccctgtctttgtctccaggggaaagagccaccctctcctgcaggaccagtcaatttgttaacagcaactacttagcctggtaccaacagacacctggccaggctcccaggctcctcatctatggtgcatccagcagggccactggcatcccagacaggttcagtggcactgggtatgggacagacttcactctcaccatcagcagactggagcctgaagattatggaacttactactgtcagcagagttccagaaccccgtggacgttcggccaagggaccagagtggaaatcaaa

SEQ ID NO: 1763 - DNA, 324 bp, Artificial Sequence
  Description of Artificial Sequence: Synthetic polynucleotide
gagatcgtgctgacccagtcccctggcaccctgtctctgtctcccggcgagagagccaccctgtcctgccggacctcccagttcgtgaactccaactacctggcttggtatcagcagaagccaggccaggcccctagactgctgatctacggcgcctcttccagagccaccggcatccctgaccggttctccggctctggctccggcaccgacttcaccctgaccatctcccggctggaacctgaggacttcgccgtgtactactgccagcagtcctcccggaccccttggacctttggccagggcaccaaggtggagatcaag

SEQ ID NO: 1764 - protein, 109 aa, Homo sapiens; identical to SEQ ID NO: 601

SEQ ID NO: 1765 - protein, 108 aa, Artificial Sequence
  Description of Artificial Sequence: Synthetic polypeptide
EIVLTQSPGTLSLSPGERATLSCRTSQFVNSNYLAWYQQKPGQAPRLLIYGASSRATGIPDRFSGSGSGTDFTLTISRLEPEDFAVYYCQQSSRTPWTFGQGTKVEIK

SEQ ID NO: 1766 - DNA, 375 bp, Artificial Sequence
  Description of Artificial Sequence: Synthetic polynucleotide
gaggtgcaattgctggaatccggcggaggtctggtgcagcctggcggctccctgagactgtcttgcgccgcctccggcttcaccttctcccactacctgatgacctgggtgcgccaggctcctggcaagggcctcgaatgggtgtcctacatctccccctctggcggccacaccatctacgccgactccgtgaagggccggttcaccatctcccgggacaactccaagaacaccctgtatctgcagatgaactccctgagggccgaggacaccgccgtgtactactgcgccagggtggccagaggaatcgccgccaggtcccggacctcctacttcgactactggggccagggcaccctggtgaccgtgtcctcc

SEQ ID NO: 1767 - DNA, 375 bp, Homo sapiens
gaagttcaattgttagagtctggtggcggtcttgttcagcctggtggttctttacgtctttcttgcgctgcttccggattcactttctctcattaccttatgacttgggttcgccaagctcctggtaaaggtttggagtgggtttcttatatctctccttctggtggccatactatttatgctgactccgttaaaggtcgcttcactatctctagagacaactctaagaatactctctacttgcagatgaacagcttaagggctgaggacacggccgtgtattactgtgcgagagtggcccgggggatagcagctcgatcgcgaaccagctactttgactactggggccagggaaccctggtcaccgtctcaagc

SEQ ID NO: 1768 - protein, 125 aa, Artificial Sequence
  Description of Artificial Sequence: Synthetic polypeptide
EVQLLESGGGLVQPGGSLRLSCAASGFTFSHYLMTWVRQAPGKGLEWVSYISPSGGHTIYADSVKGRFTISRDNSKNTLYLQMNSLRAEDTAVYYCARVARGIAARSRTSYFDYWGQGTLVTVSS

SEQ ID NO: 1769 - protein, 125 aa, Homo sapiens; identical to SEQ ID NO: 1768

SEQ ID NO: 1770 - protein, 19 aa, Unknown
  Description of Unknown: CLIPS peptide
LVTNEECQKRYQDYKITQQ

SEQ ID NO: 1771 - protein, 5 aa, Unknown
  Description of Unknown: CLIPS peptide
SWGDI

SEQ ID NO: 1772 - protein, 8 aa, Unknown
  Description of Unknown: CLIPS peptide
HDIALIKL

SEQ ID NO: 1773 - protein, 14 aa, Unknown
  Description of Unknown: CLIPS peptide
WVTGWGFSKEKGEI

SEQ ID NO: 1774 - protein, 15 aa, Unknown
  Description of Unknown: CLIPS peptide
TPFSQIKEIIIHQNY

SEQ ID NO: 1775 - protein, 10 aa, Unknown
  Description of Unknown: CLIPS peptide
ACKGDSGGPL

SEQ ID NO: 1776 - protein, 16 aa, Unknown
  Description of Unknown: CLIPS peptide
AHCFDGLPLQDVWRIY

SEQ ID NO: 1777 - protein, 638 aa, Homo sapiens [sequence omitted]

SEQ ID NO: 1778 - protein, 636 aa, Bos taurus
MIALRQAAYFICLFATVSCGCLTQLYHNIFFRGGDVSAMYTPDAQYCQLMCTFHPRCLLFSFLPENSTSDADKRFGCFLKDSVTGTLPRVSRTGAISGHSLKRCGHQISACHRSIYKGIDMRGVNFNASKVRSAKECQERCTNNIHCQFFTYATKTFFSAEYRNTCLLKRSPQGTPTRIKVLSDVESGFSLKACGNSKIGCRVDIFQHSAFSDVDVAGIIAPDAFVCRTICTYHPSCLFFTFYTNAWKTDSQRNVCFLKTSQSGSPSSPTPQENAISGYSLLTCKQTLPGTEPCHSKIYPQVAFEGEELHVTFVKGVDGCQETCTKMIRCQFFTYSLFPEDCRGEKCKCSLRLSLDGSPTNITYGTQASSGYSLRLCKRGDSRVCTTKRTRIVGGTNASWGEWPWQVSLQVKQRAQSHLCGGSIIGRQWVLTAAHCFDGLLLSNIWRIYGGILNLSEITTETSFSQIKEIIVHPNYKISEGSHDIALIKLEAPLNFTDLQKAICLPSKDDTKPVYTDCWITGWGFTEEKGKIQNTLQKANIPLISNEECQKSYRDYKITKQMICAGYKEGGKDACKGDSGGPLVCQHEETWHLVGITSWGEGCARREQPGVYTKVAEYVDWILEKTQDSHGQPLRK

SEQ ID NO: 1779 - protein, 638 aa, Mus musculus; identical to SEQ ID NO: 57

SEQ ID NO: 1780 - protein, 638 aa, Rattus norvegicus
FHPNCLFFTFYTNEWETESQRNVCFLKTSKSGRPSPPIIQENAVSGYSLFTCRKARPEPCHFKIYSGVAFEGEELNATFVQGADACQETCTKTIRCQFFTYSLLPQDCKAEGCKCSLRLSTDGSPTRITYEAQGSSGYSLRLCKVVESSDCTTKINARIVGGTNSSLGEWPWQVSLQVKLVSQNHMCGGSIIGRQWILTAAHCFDGIPYPDVWRIYGGILNLSEITNKTPFSSIKELIIHQKYKMSEGSYDIALIKLQTPLNYTEFQKPICLPSKADTNTIYTNCWVTGWGYTKERGETQNILQKATIPLVPNEECQKKYRDYVITKQMICAGYKEGGIDACKGDSGGPLVCKHSGRWQLVGITSWGEGCARKEQPGVYTKVAEYIDWILEKIQSSKERALETSPAMILFKQVGYFVSLFATVSCGCLSQLYANTFFRGGDLAAIYTPDAQHCQKMCTFHPRCLLFSFLAVSPTKETDKRFGCFMKESITGTLPRIHRTGAISGHSLKQCGHQLSACHQDIYEGLDMRGSNFNISKTDSIEECQKLCTNNIHCQFFTYATKAFHRPEYRKSCLLKRSSSGTPTSIKPVDNLVSGFSLKSCALSEIGCPMDIFQHFAFADLNVSQVVTPDAFVCRTVCT

SEQ ID NO: 1781 - protein, 643 aa, Sus scrofa
MEVIVLFRIISFRQAVYFMCLFAAVSCGCLPQLHKNTFFRGGDVSAMYTPSARHCQMMCTFHPRCLLFSFLPADSTSVTDKRFGCFLKDSVTGMLPRVLRENAISGHSLKQCGHQIRACHRDIYKGIDMRGVNFNVSKVKTVEECQERCTNSIHCLFFTYATQAFNNAEYRNNCLLKHSPGGTPTSIKVLANVESGFSLKPCADSEIGCHMDIFQHLAFSDVDVARVIAPDAFVCRTICTYHPNCLFFTFYTNAWKIESQRNVCFLKTSHSGTPSFPTPQENAISGYSLLTCKQTLPEPCHSKIYSEVDFEGEELNVTFVQGANLCQETCTKTIRCQFFTYSLHPEDCRGEKCKCSLRLSSDGSPTKITHGMRASSGYSLRLCRSGDHSACATKANTRIVGGTDSFLGEWPWQVSLQAKLRAQNHLCGGSIIGHQWVLTAAHCFDGLSLPDIWRIYGGILNISEITKETPFSQVKEIIIHQNYKILESGHDIALLKLETPLNYTDFQKPICLPSRDDTNVVYTNCWVTGWGFTEEKGEIQNILQKVNIPLVSNEECQKSYRDHKISKQMICAGYKEGGKDACKGESGGPLVCKYNGIWHLVGTTSWGEGCARREQPGVYTKVIEYMDWILEKTQDDDGQSWMK

SEQ ID NO: 1782 - protein, 629 aa, Xenopus laevis
MACYYSSLLFLLLFTLVSGGCISELYQDIYWQGGDLRSVFAPDVEYCQLVCTFSPRCLMFSYLPASWPKENERFACYLKESATNMLPKVTLTGVISGHSLKNCKSKINVCRDKNFPGIDMIGTNYNVTSTANVQQCKEGCTNDIYCQYFTYVTQEFHSAQLRNRCYFKYSGKGMPTRIRLLDNVISGFSLKACGKSSLGCQNDLFQNMELPGETLTRVFAPDVLTCQKICTFYPNCLFFTFFKKDSKDPLQRNVCYVRTSTKGIPDEVINKEHTISGFSLLSCKFSPSVCPLTMLSDSEFLGDELLVEEVSGEKECQQACTNNIRCQFFTYGPVKSGCLEKKCKCHMKISSNGLPTGIRHGNGGISGFSLRLCKMKSVKGCGEPSEHANRIVGGTDSVLGEWPWQVSMHLRLGASYKKHACGGSIISNQWIVTAAHCVALYPQPQMWIIYSGFVRILNITKSTPFSELEKIIIHPHYTGAGNGSDIALLKLKTPIVFNDHQKAICLPPSEATLVLPNSCWITGWGYTEETGSPGNVLQKAEVPPISTEECQGSYVETRIDKKVLCAGYKSGKIDACKGDSGGPLVCEVDEIWYLTGITSWGEGCARPGKPGVYTRVSTFTNWILEHTKL

SEQ ID NO: 1783 - protein, 641 aa, Macaca sp.
MILFKQATYFISLFATVSCGCLTQLYENAFFRGGDVASMYTPNAQHCQMMCTFHPRCLLFSFLPASSINDMEKRFGCFLKDSVTGTLPKVRRAGAISGHSLKQCGHQISACHRDIYKGIDMRGVNFNVSKVSSVEECQKRCTNNIRCQFFSYATQTFHNAEYRNTCLLKHSPGGTPTTIKVLNNVESGFSLKPCALSEIGCHMNIFQHLAFSDVDVARVLAPDAFVCRTICTYHPSCLFFTFYTNAWKIESQRRVCMLAGSQDGAAHSSLGDARLRLKQKNKNKQTKKNTLPEPCHSKIYPGVDFGGEELNVTFVKGVNVCQETCTKMIRCQFFTYSLLPEDCKEEKCKCFLRLSSDGSPTRITYGTQGSSGYSLRLCNTGDSSVCTTKTSSRIVGGTNSSWGEWPWQVSLQVKLMAQRHLCGGSLIGHQWVLTAAHCFDGLPLPDVWRIYSGILNLSDITKETPFSQIKEIIIHQNYRISEGNHDIALIKLQAPLNYTEFQKPICLPSKGDTNTIYTNCWVTGWGFSKEKGEIQDILQKVNIPLVTNEECQKRYQDYKITQRMVCAGYKEGGKDACKGDSGGPLACKHNGMWRLVGITSWGEGCARREQPGVYTKVAEYMDWILEKTQSSDGNARMQAPA

SEQ ID NO: 1784 - protein, 629 aa, Canis familiaris
MLIKLPLKWVSQGCLTQLYKNTFFKGGDLTAMYTPNAHHCQMMCTFHPRCLLFSFLPESSTNDVNKRFGCFLKDSVTETLPRMSWTSAISGHSLKQCGHQISACHRDIHKGIDMRGVNFNVSKVKSVEECQKKCTNSIHCQFFTYATETFYNVEYRNSCLLKNGPGGTPSSIKVLADVVSGFSLKSCALSEIGCHMNIFQHLAFSDVDVARVVTPDAFVCQTICTYHPNCLFFTFYTKAWHLEPQRNVCFLKTSKSGTPSSPTSQKNAMSGYSLLTCKKALPEPCHSKIYSGVDFEGEELNVTFAEGVNACQETCTKMIRCQFFTYSLRPEDCRGEKCKCSLRLSLDGSPTGMTYGTRVSSGYSLRLCKSGDSSVCTTKTSTRIVGGTNSSWGEWPWQVSLQVKLRAQSHLCGGSIIGRQWVLTAAHCFDELSLPDVWRIYSGILNLSEITKETPFSQIKEIIIHQNYKITDGGSYDIALIKLEAPLNYTEFQKPICLPSKDDTNTTYTNCWVTGWGFTKERGEIQNSLQKANIPLVPNEECQKKYRDYEVNKQMICAGYKEGGKDACKGDSGGPLVCKHNGNWHLVGITSWGEGCGRREQPGVYTKVAEYVDWILEKTQVGDGHAGLG

What is claimed is:

1. A method for treating mucositis, the method comprising administering an effective amount of an isolated inhibitor of kallikrein to a subject having mucositis or at risk for developing mucositis, wherein the inhibitor of kallikrein comprises a polypeptide that comprises the amino acid sequence: Xaa1 Xaa2 Xaa3 Xaa4 Cys Xaa6 Xaa7 Xaa8 Xaa9 Xaa10 Xaa11 Gly Xaa13 Cys Xaa15 Xaa16 Xaa17 Xaa18 Xaa19 Xaa20 Xaa21 Xaa22 Xaa23 Xaa24 Xaa25 Xaa26 Xaa27 Xaa28 Xaa29 Cys Xaa31 Xaa32 Phe Xaa34 Xaa35 Gly Gly Cys Xaa39 Xaa40 Xaa41 Xaa42 Xaa43 Xaa44 Xaa45 Xaa46 Xaa47 Xaa48 Xaa49 Xaa50 Cys Xaa52 Xaa53 Xaa54 Cys Xaa56 Xaa57 Xaa58 (SEQ ID NO: 1),
wherein Xaa1, Xaa2, Xaa3, Xaa4, Xaa56, Xaa57 or Xaa58 are each individually any amino acid or absent;
Xaa10 is Asp;
Xaa11 is Asp;
Xaa13 is Pro;
Xaa15 is Arg;
Xaa16 is Ala;
Xaa17 is Ala;
Xaa18 is His;
Xaa19 is Pro;
Xaa21 is Trp;
Xaa22 is an amino acid selected from the group consisting of: Tyr and Phe;
Xaa23 is an amino acid selected from the group consisting of: Tyr and Phe;
Xaa31 is Glu;
Xaa32 is Glu;
Xaa34 is Ile;
Xaa35 is an Tyr;
Xaa39 is Glu;
Xaa40 is an amino acid selected from the group consisting of: Gly and Ala;
Xaa43 is an amino acid selected from the group consisting of: Asn and Gly;
Xaa45 is an amino acid selected from the group consisting of: Phe and Tyr; and wherein the polypeptide inhibits plasma kallikrein.

2. The method of claim 1, wherein the polypeptide comprises: Met His Ser Phe Cys Ala Phe Lys Ala Asp Asp Gly Pro Cys Arg Ala Ala His Pro Arg Trp Phe Phe Asn Ile Phe Thr Arg Gln Cys Glu Glu Phe Be Tyr Gly Gly Cys Glu Gly Asn Gln Asn Arg Phe Glu Ser Leu Glu Glu Cys Lys Lys Met Cys Thr Arg Asp (amino acids 3-60 of SEQ ID NO:2).

3. The method of claim 1, wherein the polypeptide consists of: Met His Ser Phe Cys Ala Phe Lys Ala Asp Asp Gly Pro Cys Arg Ala Ala His Pro Arg Trp Phe Phe Asn Ile Phe Thr Arg Gln Cys Glu Glu Phe Be Tyr Gly Gly Cys Glu Gly Asn Gln Asn Arg Phe Glu Ser Leu Glu Glu Cys Lys Lys Met Cys Thr Arg Asp (amino acids 3-60 of SEQ ID NO:2).

4. The method of claim 1, wherein the polypeptide comprises: Glu Ala Met His Ser Phe Cys Ala Phe Lys Ala Asp Asp Gly Pro Cys Arg Ala Ala His Pro Arg Trp Phe Phe Asn Ile Phe Thr Arg Gln Cys Glu Glu Phe Be Tyr Gly Gly Cys Glu Gly Asn Gln Asn Arg Phe Glu Ser Leu Glu Glu Cys Lys Lys Met Cys Thr Arg Asp (SEQ ID NO:2).

5. The method of claim 1, wherein the polypeptide consists of: Glu Ala Met His Ser Phe Cys Ala Phe Lys Ala Asp Asp Gly Pro Cys Arg Ala Ala His Pro Arg Trp Phe Phe Asn Ile Phe Thr Arg Gln Cys Glu Glu Phe Ile Tyr Gly Gly Cys Glu Gly Asn Gln Asn Arg Phe Glu Ser Leu Glu Glu Cys Lys Lys Met Cys Thr Arg Asp (SEQ ID NO:2).

6. The method of claim 1, wherein the mucositis is selected from the group consisting of oral, esophageal, pharyngeal and gastrointestinal mucositis.

7. The method of claim 6, wherein the mucositis is oral mucositis.

8. The method of claim 1, further comprising administering palifermin.

* * * * *